United States Patent
Shen et al.

(10) Patent No.: US 10,174,119 B2
(45) Date of Patent: Jan. 8, 2019

(54) BINDING PROTEINS AND METHODS OF USE THEREOF

(71) Applicant: NGM Biopharmaceuticals, Inc., South San Francisco, CA (US)

(72) Inventors: Wenyan Shen, Redwood City, CA (US); Jie Tang, Palo Alto, CA (US); Yan Wang, Foster City, CA (US); Hugo Matern, San Mateo, CA (US)

(73) Assignee: NGM Biopharmaceuticals, Inc., South San Francisco, CA (US)

( * ) Notice: Subject to any disclaimer, the term of this patent is extended or adjusted under 35 U.S.C. 154(b) by 0 days.

(21) Appl. No.: 15/449,839

(22) Filed: Mar. 3, 2017

(65) Prior Publication Data

US 2017/0306031 A1 Oct. 26, 2017

Related U.S. Application Data

(60) Provisional application No. 62/316,516, filed on Mar. 31, 2016.

(51) Int. Cl.
| | |
|---|---|
| *A61K 39/395* | (2006.01) |
| *C07K 16/00* | (2006.01) |
| *C07K 16/18* | (2006.01) |
| *C07K 16/28* | (2006.01) |
| *C07K 14/475* | (2006.01) |
| *A61K 39/00* | (2006.01) |

(52) U.S. Cl.
CPC ........ *C07K 16/2866* (2013.01); *C07K 14/475* (2013.01); *C07K 16/2863* (2013.01); *A61K 2039/505* (2013.01); *C07K 2299/00* (2013.01); *C07K 2317/24* (2013.01); *C07K 2317/30* (2013.01); *C07K 2317/34* (2013.01); *C07K 2317/55* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | |
|---|---|---|
| 5,194,596 A | 3/1993 | Tischer |
| 5,350,836 A | 9/1994 | Kopchick |
| 5,876,969 A | 3/1999 | Fleer et al. |
| 5,994,102 A | 11/1999 | Hudson et al. |
| 6,051,424 A | 4/2000 | Kato et al. |
| 6,107,476 A | 8/2000 | Erlander et al. |
| 6,165,470 A | 12/2000 | Becquart et al. |
| 6,180,602 B1 | 1/2001 | Kato et al. |
| 6,420,543 B1 | 7/2002 | Lee et al. |
| 6,448,043 B1 | 9/2002 | Choi et al. |
| 6,465,181 B2 | 10/2002 | Biling-Medel et al. |
| 6,500,638 B2 | 12/2002 | Hudson et al. |
| 6,521,227 B1 | 2/2003 | Hudson et al. |
| 6,524,802 B1 | 2/2003 | Lee et al. |
| 6,686,179 B2 | 2/2004 | Fleer et al. |
| 6,905,688 B2 | 6/2005 | Rosen et al. |
| 6,972,322 B2 | 12/2005 | Fleer et al. |
| 6,989,365 B2 | 1/2006 | Fleer et al. |
| 7,056,701 B2 | 6/2006 | Fleer et al. |
| 7,081,354 B2 | 7/2006 | Fleer et al. |
| 7,094,577 B2 | 8/2006 | Fleer et al. |
| 7,141,661 B2 | 11/2006 | Eling et al. |
| 7,157,235 B2 | 1/2007 | Breit et al. |
| 7,244,833 B2 | 7/2007 | Yu et al. |
| 7,276,593 B2 | 10/2007 | Vernet et al. |
| 7,282,351 B2 | 10/2007 | Hudson et al. |
| 7,348,004 B2 | 3/2008 | Peters et al. |
| 7,410,779 B2 | 8/2008 | Fleer et al. |
| 7,435,410 B2 | 10/2008 | Fleer et al. |
| 7,442,371 B2 | 10/2008 | Yu et al. |
| 7,514,221 B2 | 4/2009 | Breit et al. |
| 7,576,185 B2 | 8/2009 | Grimaldi et al. |
| 7,754,689 B2 | 7/2010 | Lu et al. |
| 7,833,521 B2 | 11/2010 | Fleer et al. |
| 7,863,239 B2 | 1/2011 | Timmerman et al. |
| 7,919,084 B2 | 4/2011 | Breit et al. |
| 7,968,303 B2 | 6/2011 | Breit et al. |
| 8,021,880 B2 | 9/2011 | Peters et al. |
| 8,067,548 B2 | 11/2011 | Wang et al. |
| 8,084,021 B2 | 12/2011 | Yu et al. |
| 8,192,735 B2 | 6/2012 | Breit et al. |
| 8,222,384 B2 | 7/2012 | Wolfman et al. |
| 8,252,739 B2 | 8/2012 | Rosen et al. |
| 8,592,532 B2 | 11/2013 | Kannan et al. |
| 8,946,146 B2 | 2/2015 | Breit et al. |
| 8,986,698 B2 | 3/2015 | Arnason et al. |
| 9,161,966 B2 | 10/2015 | Matern et al. |
| 9,827,291 B2 | 11/2017 | Matern et al. |
| 9,828,415 B2 | 11/2017 | Matern et al. |
| 2001/0011077 A1 | 8/2001 | Albone et al. |
| 2003/0023073 A1 | 1/2003 | Hsiao et al. |
| 2003/0053431 A1 | 3/2003 | Madour et al. |
| 2003/0232347 A1 | 12/2003 | Anderson et al. |
| 2003/0232385 A1 | 12/2003 | Breit et al. |
| 2004/0029770 A1 | 2/2004 | Baek et al. |
| 2004/0053325 A1 | 3/2004 | Breit et al. |
| 2004/0253207 A1 | 12/2004 | Hruska et al. |
| 2005/0123546 A1 | 6/2005 | Umana et al. |
| 2006/0148709 A1 | 7/2006 | Unsicker et al. |
| 2006/0253913 A1 | 11/2006 | Huang et al. |
| 2007/0077598 A1 | 4/2007 | Breit et al. |
| 2007/0166310 A1 | 7/2007 | Hudson et al. |

(Continued)

FOREIGN PATENT DOCUMENTS

| | | |
|---|---|---|
| CN | 1544465 A | 11/2004 |
| EP | 1179067 B1 | 12/2006 |

(Continued)

OTHER PUBLICATIONS

Thakur et al. (2018, Blood Reviews, https://doi.org/10.1016/j.blre.2018.02.004).*

(Continued)

*Primary Examiner* — Elizabeth C. Kemmerer
(74) *Attorney, Agent, or Firm* — Jones Day

(57) ABSTRACT

The present disclosure provides binding proteins, such as antibodies, that bind to a GDNF Family Receptor Alpha Like (GFRAL) protein, including human GFRAL protein, and methods of their use.

43 Claims, 98 Drawing Sheets

Specification includes a Sequence Listing.

(56) References Cited

U.S. PATENT DOCUMENTS

| | | |
|---|---|---|
| 2008/0131908 A1 | 6/2008 | Li et al. |
| 2009/0004181 A1 | 1/2009 | Breit et al. |
| 2009/0042780 A1 | 2/2009 | Knopf et al. |
| 2009/0104215 A1 | 4/2009 | Ekiel et al. |
| 2009/0291889 A1 | 11/2009 | Breit et al. |
| 2010/0112692 A1 | 5/2010 | Rezania et al. |
| 2010/0184217 A1 | 7/2010 | Cegilski et al. |
| 2010/0221777 A1 | 9/2010 | Choe et al. |
| 2010/0261284 A1 | 10/2010 | Spanuth |
| 2010/0266707 A1 | 10/2010 | Breit et al. |
| 2010/0278843 A1 | 11/2010 | Breit et al. |
| 2010/0286067 A1 | 11/2010 | DeFrees |
| 2011/0033886 A1 | 2/2011 | Hess et al. |
| 2011/0039284 A1 | 2/2011 | Breit et al. |
| 2011/0065204 A1 | 3/2011 | Wollert et al. |
| 2011/0107821 A1 | 5/2011 | Hess et al. |
| 2011/0123454 A1 | 5/2011 | Breit et al. |
| 2011/0257022 A1 | 10/2011 | Hess et al. |
| 2011/0262444 A1 | 10/2011 | Kim et al. |
| 2011/0263443 A1 | 10/2011 | Hess et al. |
| 2011/0300562 A1 | 12/2011 | Lambrecht et al. |
| 2012/0107420 A1 | 5/2012 | Breit et al. |
| 2012/0128624 A1 | 5/2012 | Yu et al. |
| 2012/0309697 A1 | 12/2012 | Breit et al. |
| 2012/0321557 A1 | 12/2012 | Kimura |
| 2013/0004484 A1 | 1/2013 | Demeule et al. |
| 2013/0071935 A1 | 3/2013 | Bergman et al. |
| 2013/0323835 A1 | 12/2013 | McDonald et al. |
| 2014/0213511 A1 | 1/2014 | Matern et al. |
| 2014/0044674 A1 | 2/2014 | Duerner et al. |
| 2014/0086915 A1 | 3/2014 | Breit et al. |
| 2014/0113370 A1 | 4/2014 | Camphausen et al. |
| 2014/0193427 A1 | 7/2014 | Lerner et al. |
| 2014/0199294 A1 | 7/2014 | Mimoto et al. |
| 2014/0314711 A1 | 10/2014 | Scheer et al. |
| 2015/0023960 A1 | 1/2015 | Lindhout et al. |
| 2015/0030600 A1 | 1/2015 | Marks et al. |
| 2015/0139982 A1 | 5/2015 | Stuible et al. |
| 2015/0246971 A1 | 9/2015 | Imhof et al. |
| 2015/0322081 A1 | 11/2015 | Hoehn |
| 2015/0376294 A1 | 12/2015 | Nielsen et al. |
| 2016/0031960 A1 | 2/2016 | Lindhout et al. |
| 2016/0046724 A1 | 2/2016 | Brogdon et al. |
| 2016/0120999 A1 | 5/2016 | Shen et al. |
| 2016/0129082 A1 | 5/2016 | Matern et al. |

FOREIGN PATENT DOCUMENTS

| | | |
|---|---|---|
| EP | 1279039 B1 | 1/2008 |
| EP | 1914554 A2 | 4/2008 |
| EP | 0833912 B1 | 2/2009 |
| EP | 2383571 A1 | 11/2011 |
| EP | 2439535 A1 | 4/2012 |
| EP | 2441466 A1 | 4/2012 |
| EP | 2774620 A1 | 9/2014 |
| EP | 2929891 A1 | 10/2015 |
| JP | 07-258293 | 10/1995 |
| WO | WO 1994/003599 A1 | 2/1994 |
| WO | WO 1996/018730 A1 | 6/1996 |
| WO | WO 1997/000958 A1 | 1/1997 |
| WO | WO 1997/036926 A1 | 10/1997 |
| WO | WO 1998/011224 A1 | 3/1998 |
| WO | WO 1999/006445 A1 | 2/1999 |
| WO | WO 2001/081928 A1 | 11/2001 |
| WO | WO 2002/092620 A2 | 11/2002 |
| WO | WO 2005/099746 A1 | 10/2005 |
| WO | WO 2005/113585 A2 | 12/2005 |
| WO | WO 2003/000448 A1 | 1/2006 |
| WO | WO 2008/013454 A2 | 1/2008 |
| WO | WO 2009/021293 A1 | 2/2009 |
| WO | WO 2009/046495 A1 | 4/2009 |
| WO | WO 2009/089004 A1 | 7/2009 |
| WO | WO 2009/141357 A1 | 11/2009 |
| WO | WO 2010/019263 A2 | 2/2010 |
| WO | WO 2010/048670 A1 | 5/2010 |
| WO | WO 2010/093925 A2 | 8/2010 |
| WO | WO 2010/099219 A2 | 9/2010 |
| WO | WO 2010/129503 A1 | 11/2010 |
| WO | WO 2011/005621 A1 | 1/2011 |
| WO | WO 2011/050407 A1 | 5/2011 |
| WO | WO 2011/057120 A1 | 5/2011 |
| WO | WO 2011/064758 A2 | 6/2011 |
| WO | WO 2011/127458 A3 | 10/2011 |
| WO | WO 2012/025355 A1 | 3/2012 |
| WO | WO 2012/138919 A2 | 10/2012 |
| WO | WO 2013/012648 A1 | 1/2013 |
| WO | WO 2013/113008 A1 | 8/2013 |
| WO | WO 2013/148117 A1 | 10/2013 |
| WO | WO 2014/000042 A1 | 1/2014 |
| WO | WO 2014/100689 A1 | 6/2014 |
| WO | WO 2014/140374 A2 | 9/2014 |
| WO | WO 2014/200898 A2 | 12/2014 |
| WO | WO 2015/017710 A1 | 2/2015 |
| WO | WO 2017/013188 A1 | 1/2017 |
| WO | WO 2017/121865 A1 | 7/2017 |
| WO | WO 2017/147742 A1 | 9/2017 |

OTHER PUBLICATIONS

Yu et al. (2017, J. Hematol. Oncol. 10:155-170).*
"Glucose metabolism disroders" http://ctdbase.org/detail.go?type=disease&acc=MESH%3AD044882, Mar. 25, 2016, 1 page.
Adams et al., "Keystone Symposia—Poster Abstracts. Neuronal Control of Appetite, Metabolism and Weight (Z5)." Curent as of May 4, 2017. Poster No. 1001. "*Glutamatergic Neurons Mediate the Anorectic and Weight Loss Effects of Liraglutide.*"
Bauskin et al., "The Propeptide Mediates Formation of Stromal Stores of PROMIC-1: Role in Determining Prostate Cancer Outcome," Cancer Res. 65(6):2330-2336 (2005).
Bauskin et al., "The propeptide of macrophage inhibitory cytokine (MIC-1), a TGF-β superfamily member, acts as a quality control determinant for correctly folded MIC-1," EMBO J. 19(10):2212-2220 (2000).
Benjamin et al., "A plasticity window for blood vessel remodeling is defined by pericyte coverage of the preformed endothelial network and is regulated by PDGF-B and VEGF," Development 125(9):1591-1598 (1998).
Bootcov et al., "MIC-1, a novel macrophage inhibitory cytokine, is a divergent member of the TGF-β superfamily," Proc. Natl. Acad. Sci. U.S.A. 94(21):11514-11519 (1997).
Böttner et al., "Characterization of the rat, mouse, and human genes of growth/differentiation factor-15/macrophage inhibiting cytokine-1 (GDF-15/MIC-1)," Gene 237(1): 105-111 (1999).
Breit et al., "The TGF-β superfamily cytokine, MIC-1/GDF15: a pleotrophic cytokine with roles in inflammation, cancer and metabolism," Growth Factors 29(5):187-195 (2011).
Chen et al., "Substitution of asparagine residues in Aspergillus awamori glucoamylase by site-directed mutagenesis to eliminate N-glycosylation and inactivation by deamidation," Biochem J. 301(Pt1):275-281 (1994).
Clee et al., "The genetic landscape of type 2 diabetes in mice," Endocr. Rev. 28(1):48-83 (2007).
De Oliveira Neto et al., "Interleukin-22 forms dimers that are recognized by two interleukin-22R1 receptor chains," Biophys. J. 94(5):1754-1765 (2008).
Dostálová et al., "Increased serum concentrations of macrophage inhibitory cytokine-1 in patients with obesity and type 2 diabetes mellitus: the influence of very low calorie diet," Eur. J. Endocrinol. 161(3):397-404 (2009).
Ehses et al., "Increased number of islet-associated macrophages in type 2 diabetes," Diabetes 56(9):2356-2370 (2007).
Emmerson et al., "The metabolic effects of GDF15 are mediated by the orphan receptor GFRAL," Nat. Med. 23(10):1215-1219 (2017).
Fairlie et al., "Expression of a TGF-β superfamily protein, macrophage inhibitory cytokine-1, in the yeast *Pichia pastoris*," Gene 254(1-2):67-76 (2000).

(56) References Cited

OTHER PUBLICATIONS

Fairlie et al., "The propeptide of the transforming growth factor-beta superfamily member, macrophage inhibitory cytokine-1 (MIC-1), is a multifunctional domain that can facilitate protein folding and secretion," J. Biol. Chem. 276(20): 16911-16918 (2001).

Friedman et al., "Degradation of growth hormone releasing factor analogs in neutral aqueous solution is related to deamidation of asparagine residues. Replacement of asparagine residues by serine stabilizes," Int. J. Pept. Protein Res. 37(1):14-20 (1991).

Hamann et al., "Regulation of energy balance by leptin," Exp. Clin. Endocrinol Diabetes 104(4):293-300 (1996).

Hromas et al., "PLAB, a novel placental bone morphogenetic protein" Biochim. Biophys. Acta 1354(1):40-44 (1997).

Hsu et al., "Non-homeostatic body weight regulation through a brainstem-restricted receptor for GDF15," Nature 550(7675):255-259 (2017).

Johnen et al., "Tumor-induced anorexia and weight loss are mediated by the TGF-beta superfamily cytokine MIC-1," Nat. Med. 13(11):1333-1340 (2007).

Lajer et al., "Plasma growth differentiation factor-15 independently predicts all-cause and cardiovascular mortality as well as deterioration of kidney function in type 1 diabetic patients with nephropathy," Diabetes Care 33(7):1567-1572 (2010).

Lind et al., "Growth-differentiation factor-15 is an independent marker of cardiovascular dysfunction and disease in the elderly: results from the Prospective Investigation of the Vasculature in Uppsala Seniors (PIVUS) Study," Eur. Heart J. 30(19):2346-2353 (2009).

Lingvay et al., "Effect of Insulin Glargine Up-titration vs Insulin Degludec/Liraglutide on Glycated Hemoglobin Levels in Patients with Uncontrolled Type 2 Diabetes," JAMA 315(9):898-907 (2016).

Liu et al., "Enhancing the secretion of recombinant proteins by engineering N-glycosylation sites," Biotechnol. Prog. 25(5):1468-1475 (2009).

Macia et al., "Macrophage Inhibitory Cytokine 1 (MIC-1/GDF15) Decreases Food Intake, Body Weight and Improves Glucose Tolerance in Mice on Normal & Obesogenic Diets," PLoS ONE 7(4):e34868 (2012).

Massagué, "The TGF-beta Family of Growth and Differentiation Factors", Cell, 49(4):437-438 (1987).

Mullican et al., "GFRAL is the receptor for GDF15 and the ligand promotes weight loss in mice and nonhuman primates," Nat. Med. 23(10):1150-1157 (2017).

Ngo et al., "Computational Complexity, Protein Structure Prediction, and Levinthal Paradox", The Protein Folding Problem and Tertiary Structure Prediction, Birkhauser, Boston, 492-495 (1994).

Paralkar et al., "Cloning and characterization of a novel member of the transforming growth factor-beta/bone morphogenetic protein family," J. Biol. Chem. 273(22):13760-13767 (1998).

Robinson et al., "Prediction of primary structure deamidation rates of asparaginyl and glutaminyl peptides through steric and catalytic effects," J. Pept. Res. 63(5):437-448 (2004).

Saarma and Goldman, "Receptors identified for a weight regulator," Nature 550:195-197 (2017).

Schindowski et al., "Regulation of GDF-15, a distant TGF-β superfamily member, in a mouse model of cerebral ischemia," Cell Tissue Res. 343(2):399-409 (2011).

Soler et al., "New experimental models of diabetic nephropathy in mice models of type 2 diabetes: efforts to replicate human nephropathy," Exp. Diabetes Res. 2012:616313 (2012).

Tokuriki et al., "Stability effects of mutations and protein evolvability," Curr. Opin. Struc. Biol. 19(5):596-604 (2009).

Vila et al., "The relationship between insulin resistance and the cardiovascular biomarker growth differentiation factor-15 in obese patients," Clin. Chem. 57(2):309-316 (2011).

Wells, "Additivity of Mutational Effects in Proteins," Biochemistry 29(37):8509-8517 (1990).

Welsh et al., "Large-scale delineation of secreted protein biomarkers overexpressed in cancer tissue and serum," Proc. Natl. Acad. Sci. U.S.A. 100(6):3410-3415 (2003).

Yang et al., "GFRAL is the receptor for GDF15 and is required for the anti-obesity effects of the ligand," Nat. Med. 23(10):1158-1166 (2017).

Yokoyama-Kobayashi et al., "Human cDNA encoding a novel TGF-beta superfamily protein highly expressed in placenta" J. Biochem. 122(3):622-626 (1997).

Goodman et al., "RET recognition of GDNF-GFRα1 ligand by a composite binding site promotes membrane-proximal self-association," *Cell Rep.*, 8:1894-1904, Supplemental Information (2014).

\* cited by examiner

FIG. 1

```
Human            -MIVFIFLAMGLSLENEYTSQTNNCTYLREQCLRDANGCKHAWRVMEDACNDSDPGDPCK
Chimpanzee       -MIVFIFLAMGLSLENEYTSQTNNCTYLREQCLRDANGCKHAWRVMEDACNDSDPGDPCK
Cynomolgus       -FVVVIQALGLSLENEYTSQTNNCTYLREQCLHDANGCKHAWRIMEDACNDSDPGDPCK
Giant Panda      -MVFIFLAVALCLENESTSETIDCTYLREQCLRDANGCKHAWRIMEDSCNVSEPGNPCK
Dog              -MIVFIFLAMVLCLENESTSQTIDCTHLREQCLSDADGCKHAMRIMEYSCNVSVPGNPCK
Cat              -SVLIVISAMVLCLENESTSQTIDCTYLREQCLSDTNGCKLAWRKMEDSCNVSDPGNPCK
Pig              -SVIAVLQAVGLYLENESTSQTTDCTYLRELCLNDTDGCKQAWRIMEDACNVSDPGNTCQ
Bovine           -PLIVVTQAVGLCLN-KSASQTTDCTYLRBLCLSDADGCKHAWRIMEDACNVS--GNTCQ
Mouse            -MLVFIFLAVTLSSENESSSQTNDCAHLIQKCLIDANGCEQSWRSMEDTCLT--PGDSCK
Rat              -MLVFIFLAVRLSSENESSSQTNDCAYFMRQCLTDTDGCKQSWRSMEDACLV--SGDSCK
Chinese Hamster
Platypus         MKHYFLFVVLMLGFKCESASLTTGCLHLRKQCVSAMDGCESAWAVIEDVCNVS--GHNCT
                                 *                 *      *              *

Human            MRNSSYCNLSIQYLIVESNFQFKECLCTDDFYCTVNKLLGKKCINKSDNVKED-KFKWNLT
Chimpanzee       MRNSSYCNLSIQYLIVESNFQFKECLCTDDFYCTVNKLLGKKCINKSDNVKED-KFKWNLT
Cynomolgus       MNNSSYCNLSIQYLVESNFRFKECLCTDDFYCTVNKLLGKECVNKSDNMRED-KFKWNLT
Giant Panda      MKDSSKCNLSIQSLVESNFQFEDCLCTDNLYCTINKLLGBQCINESGNVKEDNQSKWNLT
Dog              MKDSSNCNLSIQSLVENNFQFEDCLCTDNIYCTINKLLGBQCMNESDNMKEDNQYKWNLT
Cat              MKDSSNCNLSIQSLVENNFQFEDCLCTGNLHCTINKLLGKKCINESDNMKEDNQSKWNLT
Pig              MKDSSSCNQSIQSLAESNFQFKDCLCLCSDDLYCTVNNLIGKKCTNESDNMKEDGVFKRNLT
Bovine           MKNSSSCGLSIQSLVBSNLQFKDCLCFDDLYCTPNKLFGKKCTNKTDNMEKDNKDKWNLT
Mouse            INNSLHCNLSIQALVEKNFQFKECLCLQMDDLHCTVNKLFGKKCTNKTDNMEKDNKDKWNLT
Rat              INNPLPCNLSIQSLVEKHFQFKGCLCLCTDDLHCTVNKIFGKKCTNKTDSMKKDNKYKRNLT
Chinese Hamster
Platypus         MKESLNCNLSIQLLADRYPAFKDCLCABDISCSATNFLGRKCIIKTENEHKDKNIKSLWN
                                                                            *
```

FIG. 1 (continued)

```
Human            TRSH--HGFKGMWSCLEVAEACVGDVVCNAQLASYLKACSANGNPCDLKQCQAAIRFFYQ
Chimpanzee       TRSH--HGFKGMWSCLEVAEACVGDVVCNAQLASYLKACSANGNPCDVKQCQAAIRFFYQ
Cynomolgus       THSH--HGFKGMWSCLEVAEACVGDVVCNAQLASYLKACSANGNPCDVKHCQAAIRFFYQ
Giant Panda      TLPY--QGIKGIQSCLEVAEACVGDVVCNAQLAPYLKACSANGNLCDVKHCQAAIRFFYQ
Dog              TLPY--HGIKGIQSCLEVAEACVGDVVCNTQLAAYLKACSANGNLCDVKHCQAAIRFFYQ
Cat              TLPY--NGIKGIQSCLEVAEACVGDVVCNAQLAPYLKACSANGNLCDVKHCQAAIRFFYQ
Pig              APSY--HGIRGIQSCLEVAEACVRDTVCNAQLAPYLKACSANGNLCDVKHCQAAIRFFYQ
Bovine           TLSY--HGGRGVQSCLEVAEVCIGDALCNAQLALYLKACSADGKLCDVKHCQAAIRFFYQ
Mouse            TTPF-YHGFKQMQSCLEVTEACVGDVVCNAQLALYLKACSANGNLCDVKHCQAAIRFFYQ
Rat              TPLYHDTGFKQMQSCLEVTEACVGDVVCNAQLALYLKACTANGNLCDVKHCQAAIRFFYQ
Chinese Hamster                                @  ACSANGNLCDVKHCQAAIRFFYQ
Platypus         STSLLQHGFKGTRSCLEVTVACVGDTVCNKQLARFLKDCSTHGSLCNMNQCQAAIRFFYQ
                                      *  ***  *   **  ****  *    * ** ********

Human            NIPFNIAQMLAFCDCAQSDIPCQQSKEALHSKTCAVNMVPPPTCLSVIRSCQNDELCRRH
Chimpanzee       NIPFNIAQMLAFCDCAQSDIPCQQSKEALHSKTCAVNLVPPPTCLSVIRSCQNDELCRRH
Cynomolgus       NIPFNIAQMLAFCDCSQSDIPCQQSKEALHSKPCALNMVPPPTCLNVIRSCQNDELCRRH
Giant Panda      NMPFNIAQMLAFCDCAPSDIPCQQSKEALHSKPCAVNVVPPPTCLDVIHSCRNDELCRRR
Dog              NMPFNIAQMLAFCDCAPSDIPCQQSKEALHSKPCAVNVVPPPSCLDVIHSCRNDELCRRR
Cat              SMPFNIAQMLAFCDCAPSDIPCQQSKEALHSKPCAVNIVPPPTCLNVIHSCRNDELCRRR
Pig              NMPFNVAQMLAFCDCAPSDIPCQQSKEALHSKPCALNRVPAPTCLDVIRSCQNDELCRRR
Bovine           NMPFNIAQMLAFCDCAPADEPCQQSREALHSRPCAVNRVPTPTCLDVIHSCQDDELCRTH
Mouse            NMPFNTAQMLAFCDCAQSDIPCQQSKETLHSKPCALNIVPPPTCLSVIHTCRNDELCRTV
Rat              NMPFNTAQMLAFCDCAQSDIPCQQSKETLHSKPCALNVVPPPTCLSVIHTCRNDELCRTR
Chinese Hamster  NMPFNTAQMLAFCDCAQSDIPCQQSKEALHSKPCAVNVVPPPTCLSVIHTCRNDELCRTR
Platypus         NIPFNIAQMLAFCDCAQSDIPCQQSKEALHSKPCAVNVVPTPSCLNVIRSCRDDELCRQR
                  ****  ********  *  ***** ****  **  **   *  **   *  ****
```

FIG. 1 (continued)

```
Human              YRTFQSKCWQRVTRKCHEDENCISTLSKQDLTCSGSDDCKAAYIDILGTVLQVQCTCRTI
Chimpanzee         YRTFQSKCWQRVTRKCHEDENCISTLSKQDLTCSGSDDCKAAYIDILGTVLQVQCTCRTI
Cynomolgus         YRTFQTKCWQRVTRKCHEDENCISALSKQDLTCSGSDDCKAAYIDILGTVLQVQCNCRTI
Giant Panda        YRTFQSKCWQHVTRKCHEDELCISTLSQQDLTCSGSDDCKAAYIGTGTVLQVQCTCRTI
Dog                YRTFQSKCWQHMIRKCHEDELCISTLSQQDLTCSGSDDCKAAYIGTFGTVLQVQCTCRTI
Cat                YRTFQWKCWQQVTRKCHEDEFCISTLSKQDLTCSGSDDCKAAVIGILGTVLQAQCTCRTI
Bovine             YRIFQAKCWQHVMRKCHEDETCIGTLSKQDLACSGSDDCKAAYIGTLGTVLQGQCTCRTI
Pig                YRIFQAKCWQHVTAKCHDDETCISTLNKQDFTCSRSDDCKAAYMGTLGTALQGQCTCRTT
Mouse              YRTFQTECWPHITGKCHREDETCISMLGKQDLTCSGSBSCRAAFLGTFGTVLQVPCACRGV
Rat                YRTFQTECWPHVAGKCREDETCISMLGKQDLTCSGSDSCRAAVLGTFGTVLQVPCACRSI
Chinese Hamster    YQTFQSECWFHVMGKCHEDETCIGTLGKQDLICSGSDSCRAAYIGTLGTVLHVQCTCSTL
Platypus           FETFQSKCWQDM-DKCSDDETCIVTLNKENITCSRNEECREAYIGTLGTYLHVQCTCSTL
                   * **       *     *                *  ** ** ** **    *  *

Human              TQSEESLCKIFQHMLHRKSCFNYPTLSNVKGMALYTRKHANKITLTGPHSPFNGEVIYAA
Chimpanzee         TQSEESLCKIFQHMLHRKSCFNYPTLSNVKGMALYTRKHANKITLTGPHSPFNGEVIYAA
Cynomolgus         TQSEESLCKIFQHMLHRRKSCFNYPTLSNVKGMALYTRKHTNKITLTGFQSPFHSGFHSPFNGEVIYAV
Giant Panda        TQSEESLCKIFQHMLHRRSCFDYLTLSNVKGMALHKRKPAKEITLSGFHSPFNGEVIYAV
Dog                TONEESLCKIFQHMLHGRSCFDYPTLSNVKGMALHERKHAKEITLSGFHSPFNGEVIYAV
Cat                TQGEESLCKIFQHMLHRRSCFNVPTLSNVKGIALHKRKHAKEITLSGFHSPFNGEVIYAV
Bovine             TQSEESLCKIFQHMLHRKSCFNNKPTQNLK--------------------
Pig                TQSEESLCKIFQHMLHGKSCFNYPTLSNVKGIALHKRKGIALHKEISLSGCOSPFNGEVIYAV
Mouse              TQAEEHVCMIFQHMLHSKSCFNYPT-PNVKDISSYEKKNSKEITLTGFNSFFNGELLYVV
Rat                TQGEEPLCMAFQHMLHSKSCFNYPT-PNVKDISSVERKHSKEITLTGFNSPFSGELIYVV
Chinese Hamster    TQDEEPLCMTFQHMLQSKSCFNYPT-PNVKDISSYKGKHSKEITLTGFESPFNGELVYAV
Platypus           SLTEEYLCKIFHHILHSRSCFS-----------------
                   *  *   *  *   *   *
```

FIG. 1 (continued)

```
Human            MCMTVTCGILLLVMVKLRTSRITSSKARDPSSIQIPGEL--- (1797)
Chimpanzee       MCMTVTCGILLLVMVKLRTSRITSSKARDPSPIQIPGEL--- (1832)
Cynomolgus       MCMTVTCGILLLVMVKLRTSRITSSKARDPSLSQVPGEL--- (1800)
Giant Panda      MCMTVTCGILLLVMLKLRTSRISSQTRDHSPIRIPGGL--- (1833)
Dog              MCMTVTCGILLLVMLKLRTSRISSQTRDHSPIQIPGGL--- (1834)
Cat              MCMTVTCGILLLVMLKLRTSRISSQTRDHSPVQILEEL--- (1835)
Bovine           ----------------------------------------- (1836)
Pig              MCMTVTCGILLLVMFKLRNFRISSQTRDPSPIQIPGEP--- (1837)
Mouse            VCMAVTCGILFLVMLKLR---IQSEKRDPSSIEIAGGVIIQ (1802)
Rat              VCMVVTSGILSLVMLKLR---IPSKKRDPAPIEIAGAVIIQ (1804)
Chinese Hamster  LCMVVTCGILFLVMLKLR----------------------- (1838)
Platypus         ----------------------------------------- (1839)

@ Chinese hamster
MDVLLNHSFTSFIEESTLPSDLVPRSNVTQGFLREDTFLTABRKDDCVAAABACQESVHC
SLLHENFKKACGKGTAQCHTLSGQQFCVALRESLRETVLWDCQCGFPLEGDCIRIWKGLF
EDICTEDTQINQIATFSQDNEDRLKEDIASDNLKKDNKFKWDLTTLHH (1840)
```

FIG. 2

| Species | Sequence |
|---|---|
| Human | ----------MPGQELRTVNGSQMLLVLLVLLVLLSWLPHGGALSLAEASRASFPGPS---ELHSE |
| Rhesus monkey | ----------MPGQELKTLNGSQMLLVLLVLLVLLMPPHGGAMSLAEASRASFPGPS---DLHSE |
| Gibbon | ----------MPRQEPRMLNGSQMLLVLVLLVLLVLSWPPHGGALSLAEASPASFPGPS---ELHSK |
| Chimpanzee | ----------MPRQELRTLNGSQMLLVLVLLVLLVLLSWPPHGGALSLAEASRASFSGPS---ELHSE |
| Orangutan | ----------MPRQELRTLNGFQMLLVLVLLVLLVLLSWPPHGGALSLAEASRASFPGPS---DLHSE |
| Cow | ----------MPGQRPAAPHRSRMLLMLLMFSWLRSGGALSLITQEHLQTFQGPS---NVHSS |
| Pig | ----------MPGQLPSPPRRSPTLLMLLMLSWLPSGGALSLAQEHLPALPGPS---DVHSS |
| Dog | ----------MPGQGPAPAHCSPMLVILVMLSWLPSGGALSLAQEHLPAFPGPS---DPHSS |
| Giant panda | ----------MPGQGLTPPPGSPMLLMLLMFSWLPSGGALSLAQERLPAFPGPS---DTHSS |
| Ferret | ---------HSSPMLPVILMFSWLPSGGALSLAQERLPAFPGPS---DAHSS |
| Mouse | MAPPALQAQPPGGSQLRFLLPLLLLLLLLLSWPSQGDALAMPEQR-PSGPES---------- |
| Guinea pig | ----MPA-----LGFTLLLLAAVSRPPPGGASGP-AEKLPAEPDPDLDPDRDPD |
|  |        *  *     * |

| Species | Sequence |
|---|---|
| Human | --DSRFRELRKRYEDLLTRLRANQSWEDSNTDLVPAPAVRILTPEVRLGSGGHLHLRISR |
| Rhesus monkey | --DSRFRELRKRYEDLLTRLRANQSWEDSNTDLIQAPEVRILTPEVRLGSGGHLHLRISR |
| Gibbon | --DSRFRELRKRYEDLLTRLRVNQSWEDLNTDLVPAPAVRILTPEVRLGSGGHLHLRISR |
| Chimpanzee | --DARFRELRKRYEDLLTRLRANQSWEDSNTDLVPAPAVRILTPEVRLGSGGHLHLRISR |
| Orangutan | --DSRFRELRKRYEDLLTRLRANQSWEDSNTDLVPAPAVRILTPEVRLGSGGHLHLRISR |
| Cow | PDISRFRELRKRYEDLLTRLRANQTWEDSNPDLIPPPQVRITPKLRLGPGGHLHLRIPR |
| Pig | SDVSRFRELRKRYEDLLTRLRANQTWEDSNPNLIPAPQVRIVTPKFRLGPGGHLHLRIPR |
| Dog | TDVSRIQELRKRYEHLQTKLRLNQGWADSNPDLVPATRVRILTPKLRLGPRGHLHLRIAR |
| Giant panda | TDVSRAQEFRKRYAHLQTRLWLNQSRADSNSDLIPAAQVRILTPKLRLGSGGHLHLRIAR |
| Ferret | MDISRAQEFRKHYEHLQTRLRLNQSWGDSNSDLNLTAPVRILTPVRILTPKLRLGPGGHLHLRIAL |
| Mouse | --QLNADELRGRFQDLLSRLHANQSREDSNSBPSPDPAVRILSPEVRLGSHGQLLLRVNR |
| Guinea pig | PAAHPARELRRRFEDLLARLRANRSADALPAERSPAPVVHTLTPDVRRGHDGSLHLRIPR |
|  | *      *       *          *     *    *   *      **   ** |

FIG. 2 (continued)

```
Human          AALPEGLPEASRLHRALFRLSPTASRSWDVTRPLRRQLSLARPQAPALHLRLSPPPSQSD
Rhesus monkey  AVLPEGLPEASRIHRALFRLSPTASRSWDVTRPLRRQLRLARPQAPALHLRLSPPPSQSD
Gibbon         AALPEGLPEASRLHRALFRLSPTASRSWDVTRPLRRQLSLARPQAPALHLRLSPPRSRSD
Chimpanzee     AALPEGLPEASRLHRALFRLSPTAARSWDVTRPLRRQLSLARPQAPALHLRLSPPPSQSD
Orangutan      AALPEGLPEASRLHRALFRLSPTASRSWDVTRLLRRQLSLARPQAPALHLRLSPPPSQSD
Cow            VNLTEGLPAASRLHRALIRLSPKAWSSWDVTRPLRRQLRLGGSRGPSIRLRLLARPDQ--
Pig            VNLTEGLPAASRLHRALIRLSPTARSSWDVTRPLRRQLSVGGSRGSAIHLRLRLLQRPDQ--
Dog            ADLTAGLPAASRLHRALIRLSPTEPSSWDVTRPLRRQLSRVGSRTPTLRLRLLPRWDR--
Giant panda    ADLTEGLPAASRLHRALIRLSPTEPSSWDVTRPLQRQLSLGGSRAPVLRLRLLPQWDP--
Ferret         ADLTEGLPATSRLHQALIRLSPMEPSSWDVTRPLQRQLSLGGSRASALHLRLLPRLNR--
Mouse          ASLSQGLPEAYRVHRALLLTPTA-RPWDITRPLKRALSLRGPRAPALRLRLTPPDL--
Guinea pig     ASLPPGVPRASRVQHALLIRLSPETREPWDVTRPLQRQLRLLDPRAPALLIHLWPPSDRW-
                *    *      *       *           *          *             *

Human          QLLAESSSARPQLELHLRPQAARGRRRARARNGDHCPLGPGRCCRLHTVRASLEDLGWAD
Rhesus monkey  QLLVKSSSRPQLELHLRLRLRAARGRRRARARNGDRCPLGPGRCCRLHTVHASLEDLGWAD
Gibbon         QLLAESSSARPQLELHLRPQAARGRRRARARNGDHCPLGPGRCCRLHTVRASLEDLGWAD
Chimpanzee     QLLAESSSARPQLELHLRSRAARGLRRARARNGDHCPLGPGRCCRLHTVRASLEDLGWSD
Orangutan      QLLAESSSARPQLELHLRPRAARGRRRARARNGDHCPLGPGRCCRLHTVRASLEDLGWAD
Cow            -LQEALPSAPPQLELHWRPSATRGRRHAHAHTRDGCPLGEGRCCHLQSLRASLEDLGWAD
Pig            -LLEALPAGQPQLELHWRPSSTRGRRNTHAHTRDGCPLGTGRCCRLQSLRASLEDLGWAD
Dog            -SR-ALPSARPQLELHWRPAARGRRNAHAHARDGCPLGEGRCCRLQSLRASLQDLGWAN
Giant panda    -LGATLPSARPQLELHWRPRAARGRRNAHAHGGDGCPLGEGRCCRLQSLRASLEDLGWAD
Ferret         -LRATLPSARPQLELHWRPSAARGRRDAHAHAGDGCPLGEGRCCRLQSLRASLEDLGWAN
Mouse          ---AMLPSGGTQLELRLRVAAGRCGRRSAHAHPRDSCPLGPGRCCHLETVQATLEDLGWSD
Guinea pig     ---RELSSAPPRLELHLRTRSARGRRSTRMRTRDDCPLGPGRCCRLHTVRASLQDLGWTD
                        *    **   *                  ***  *  ** *  *****  *
```

FIG. 2 (continued)

```
Human          WVLSPREVQVTMCIGACPSQFRAANMHAQIKTSLHRRLKPDTVPAPCCVPASYNPMVLIQK
Rhesus monkey  WVLSPREVQVTMCIGACPSQFREANMHAQIKMNLHRLKPDTVPAPCCVPASYNPMVLIQK
Gibbon         WVLSPREVQVTMCIGACPSQFRAANMHAQIKTSLHRLKPDTVPAPCCVPASYNPMVLIQK
Chimpanzee     WVLSPREVQVTMCIGACPSQFRAANMHAQIKTSLHRLKPDTVPAPCCVPASYNPMVLIQK
Orangutan      WVLSPREVQVTMCIGACPSQFRAANMHAQIKTSLHRLKPDTVPAPCCVPASYNPMVLIQK
Cow            WVLAPRELDVRMCIGACPSHFRSANTHAQMQARLHGLNPDAAPAPCCVPASYEPVVLMHQ
Pig            WVLAPRELDVRMCVGACPSHFRSANTHAQMQARLHGLNPDAAPAPCCVPASYEPVVLMHQ
Dog            WVVAPRELDVRMCVGACPSQFRSANTHAQMQARLHGLNPDAAPAPCCVPASYEPVVLMHQ
Giant panda    WVVAPRELDVRMCIGACPSQFRSANTHAQMQARLHGLNPEAAPAPCCVPASYEPVVLMHQ
Ferret         WVVAPRELDVRMCIGACPSQFRSANTHAQMQARLHGLNPDAAPAPCCVPASYEPVVLLHQ
Mouse          WVLSPRQLQLSMCVGECPHLYRSANTHAQIKARLHGLQPDKVPAPCCVPSSYTPVVLMHR
Guinea pig     WVLSPRELHVGICMGECPSLYRSANTHAQVKARLHGLKPDSVPAPCCVPSSYDLVVLMHK
               **  **     *  *       *      *   **  **     *  ** *   *

Human          -TDTGVSLQTYDDLLAKDCHCI   (1810)
Rhesus monkey  -TDTGVSLQTYDDLLAKDCHCV   (1841)
Gibbon         -TDTGVSLQTYDDLLAKDCHCI   (1842)
Chimpanzee     -TDTGVSLQTYDDLLAKDCHCI   (1843)
Orangutan      -TDTGVSLQTYDDLLAKDCHCI   (1844)
Cow            DSDGRVSLTPFDDLVAKDCHCV   (1845)
Pig            DSDGRVSLTPFDDLVAKDCHCV   (1846)
Dog            DSDGRVSLTPFDDLVAKDCHCV   (1847)
Giant panda    DSDGRVSLTPFDDLVAKDCHCV   (1848)
Ferret         DSDGRVSLTPFDDLVAKDCHC-   (1849)
Mouse          -TDSGVSLQTYDDLVARGCHCA   (1850)
Guinea pig     -TDGGIALHTYDDLIAKGCHCA   (1851)
                 *     *  *** *  ***
```

FIG. 4A

```
VH Domains
Kabat      1         10         22        31----35      40                  50--a----60----65
AbM        1         10         23        26----35      40                  50--a----58      65
Chothia    1         10         22        26----32      40                  a-55             65
Contact    1         10         22        30----35      40              47----a----50        65
IMGT       1         10         23        27----38  41                          56--a----65  74
AHon       1                               27       42                      57                78
1C1    QMQLKQSGPGLVQPSQSLSITCTVS GFSLND-YGVH WIRQSPGKGLEWIG VIW-SGGRTDYNAAFIS
P8G4   QVQLKQSGPGLVQPSQSLSITCTVS GFSLTS-YGVH WVRQSPGKGLDWLG VLW-SGGSTDYNAAFIS 3P10   QIQLVQSGPELKKPGETVKISCKAS GYTFTD-YGVI WVKQAPGKALKWMG WINTYTGEPTYADDLKG
12A3   QIQLVQSGPELKKPGETVKISCKAS GYPFTI-YGMN WVKQAPGKGLKWMG WINTYSGVPTYADDFKG
2B8    QIQIVQSGPELKKPGETVKISCKAS GYTFTT-YGMS WVKQAPGKIPKWMG WINTTSGVPTFVDDFKG
22N5   QMQLVQSGPELKKPGETVKISCKTS GYTFTD-YSMH WVKKTPGKGFKWMG WINTETGEPTYADDFKG 2J23   QAQLQQSGAELVKPGASVKLSCKAS GYSFTS-YNID WVRQRPEQGLEWIG WIFPGDGSTKYNEKPKG
6N16   QVQLQQSGSELVKPGTSMKLSCKAS GYTFTS-YNIN WVRLPEQGLEWIG WIFPGHDSIKYNENPRG
1B3    QVHLQQPGAELVKPGASVKLSCKAS GTFTTG-YNIN WVRLRPEQGLEWIG WIFPGDDMAKYNEKFKG 25M22  QVQLQQSGPDLVKPGASVKISCKAS GYTFTS-YWVN WMKQRPGKGLEWIG RIYPGDGTNYNQKFKG
19K19  QVQLQQSGPRDLVKPGASVKISCKAS GYAFTS-YWMN WVKQRPGKGLEWIG RIYPGLGDTNINQKFKG
5F12   QVQLQQSGTELVKPGASVKISCKAS GYTFTD-YYIN WVKQRPSQGLEWIA RIYPGNGNTYHNEKFKG 5A20   QVQLQQSGPELVKPGASVILSCKAI GYTFTD-YWIE WVKERPGHGLEWIG EILLGSDSIHPNEKPKG
8D8    QVQLKESGPGIVAPSQSLSITCTVS GFSLSR-YSVH WVRQPPGKGLEWLG MIW-GFGSTDYNSALKS
17J16  QVQLQQSGAELAKPGASVKMSCKTS GYTFTD-YWIH WVKQRPGQGLEWIG YINPNSNYAEYNQKPKV
2B3    EVKLVESGGGLVQPGGSLKLSCAAS GFTPSD-YPMP WVRQTPEKRLEWVA YISNLQDSTYYPDTVQG
8C10   QVQLQQSGVELLARPGASVKLSCKAS GYTFAN-YGLT WVKQRTQGGLEWIG EIYPGSGHTHYNEDFKG
2A9    EVKLVESGGGLVKPGSSLKLSCAAS GFTPST-YAMS WVRQTPEKRLEWVA SIT-SGGTTYYTDSVKG
24G2   QVQLQQSGAELLKPGASVKLSCKAS GYTFTT-YWMN WVKQRPGQGLEWIG MIHPNSGSSNYNEKPKN
6G9    QVQLHQPGAELVKPGASVKLSCKTS GYTFTS-YWMQ WVKQRPGQGLEWIG EIDPSDSYTNINQKPKG
2B11   DVQLQESGPGLVKPSQSLSLTCSVT GYSTTSGYYWN WIRQPPGNKLEWMG HTA-NDGSNYYNPFLKH P1B6   EVQLQQSGPELVKPGASVKMSCKAS GYTFTD-YYMN WVKQTHGKSLEWIG DINPNNGGPIYNQKFKG
1A3    EVQLQQSGPELVKPGASVKISCKAS GFTFTD-YYMN WVKQSHGKSLEWIG DIIPNNGVTSYNQKFKG
P1H8   EVQLQQSGPELVKPGASVKISCKAS GYTFTD-YYMN WVKQSHGKSLEWIG DINPMNGSTTYNQKFKG
```

FIG. 4A (continued)

```
Kabat       70            80     abc    89                                       90                    95--100-----102      110
AbM         70            80     abc                                              90                    95--100-----102      110
Chothia     70            80     abc                                              90                    96--100-----101      110
Contact     70            80     abc                                              90  93-----------100-----101              110
IMGT     75                              89                                              105--------------117
AHon                                                                                 106 109                138

1C1         RLSISKDNSKSQVFFKMSSLQPNDTAIYYCVR  WALYFLYGG---SMDY  WGQGTLVTVSS
P8G4        RLSISRDNSKSQVFFKMNSLQADDTAIYYCAR  N----------FGDY   WGQGTSVTVSS

3P10        RFAFSLETSASSASLQINNLKNEDTATYFCAR  RYGPE------DIDY   WGQGTTLTVSS
12A3        RFAFSLETSASTAYLQINMLKDEPTATYFCAS  ATG--------NY     WGQGTTLTVSS
2B8         RFAFSLETSASTAYLQIGNLKNEDTATYFCAR  RSSYYFYW----YFDV  WGTGTTVTVSS
23N5        RFAFSLRTSANTAHLQITNLKNEDTATYFCVK  GTL--------NY     WGQGTTLTVSS

2J23        QATLTTDKSSSTYIHLSRLTSEDSAVYFCAR   SGIYYGS----HFVY   WGQGTLVTVSA
6N16        KATLTTDKSSSTAYMHLSRLTSDDSAVYFCAR  SGIFYGN----NPAY   WGQGTLVTVSA
1B3         KATLTTDKSSNTAYMQLSRLTSEDSAVYFCAR  TPVLSN-----YFDY   WGQGTTLTVSS

25M22       KATLTADKSSSTAYMQLSSLTSEDSAVYFCAR  AYILLRLRRTGYYAMDY WGQGTSVTVSS
19K19       KATLTADKSSSTAYMQLSSLTSEDSAVYFCAR  AYILLRLRRTGYYAMDY WGQGTSVTVSS
5F12        KATLTARKSSSTAYMQLSSLRGEDSAVYFCAR  BGLYYDYDR---YFDY  WGQGTALTVSS

5A20        KATISADTSSNTAYMQLSSLTTEDSAIYYCVR  QDMNW------YFDV   WGTGTTVTVSS
8D8         ELGITKDNSKSQFFLKMNSLQTDDTAMYYCAR  IHTT-------AGSY   WGQGTLVTVSA
17J16       KATLTADKSSSTAYLQLSRLTSEDSAVYYCAR  FDMNW------YFHV   WGAGSTYTVSS
2B3         RFTISRDNAKNTLYLQMSRLASEDTAMYCTR   QGAQA------TLDY   WGQGTTLTVSS
8C10        KATLTADRSSSTAYMELRSLTSEDSAVYFCAR  RIQLLLPVG--GFVY   WGQGTLVTVSS
2A9         RFTISRDNARNILYLQMSSLRSEDTAMYYCAR  DGNFYYY----GMDY   WGQGTSVTVSS
24G2        KATLTVDKSSSTAYMQLSSLTSEDSAVYFCAR  SDYGFIP----YFDY   WGQGTTLTVSS
6G9         KATLTVDTSSTTAYMQLSSLTSEDSAVYFCAR  PLDRSAY----YFDY   WGQGTTLTVSS
2B11        RVSTIRDTSKNQFFLKLMSVTIQDTATYYCAR  GGSYFD-----YVDY   WGQGTLVTVSS

P1B6        KATLTVDKSSSTAYMELRSLTSEDSAVYYCAR  SDSA-------WFTY   WGQGTLVTVSA
1A3         KATLTVDKSSSTAYMELRSLTSEDSAVYYCAR  BWLLR------GMDY   WGQGTSVTVSS
P1H8        KATLTVDKSSSTAYMELRSLTSEDSAVYYCAR  QGPW-------YFDV   WGTGTTVTVSS
```

FIG. 4B

VL Domains

| Scheme | | | | | | |
|---|---|---|---|---|---|---|
| Kabat | 1 | 10 | 20 | 24-27abcde----34 | 40 | 50----56 |
| AbM | 1 | 10 | 20 | 24---30abcde---34 | 40 | 50----56 |
| Chothia | 1 | 10 | 20 | 26--30abcd--32 | 40 | 50--- |
| Contact | 1 | 10 | 20 | 30abcd------36 | 46------55 | |
| IMGT | 1 | | 23 | 27-----------38 41 | | 56-65 69 |

```
AHon    1       DVVLTQTPLSLPVSPGDQASISC  RSSQSLVHSSGITYLH  WYLQKPGQSPKLLIY  KLSNRFS
                                          23                42               58      72
1C1             DIVLTQSPVSLAVSLGQRATISC  RASRSVDNYGI-SPMS  WFQQKPGQPPKLLIY  AASHQGS
3P10            DIQMTQSPSSLSASLGERVSLTC  RASQDIG------SSLN  WLQEPDGTIKRLIY   ATSSLDS
12A3            DIQMTQSPSSLSASLGKVTTTC   KASQDIS------KYIS  WYQHKPGKSPRLLIH  YTSTLQP
1B3             QIVLTQSPAIMSASLGEITLTC   SASSSV-------FYMH  WYQQKSGTSPKLLIY  STSNLAS
2B3             DIQMTQTTSSLSASLGDRVTINC  RASQDIS------NYLN  WYQQKPDGTVKLLIY  YTSRLHS
2B11            DIQMTQSPASLSASVGEFVTITC  RPSENIY------SYLT  WFQQEQGKSPQLLVY  NAQTLAE
2B8             DIKMTQSPSSMYASLGERVTITC  KASQDIK------SYLN  WFQQKPGKSPKTLIY  RTKRLVD
22N5            QIVLTQSPAIMSASPGEKVTMTC  SASSSV-------SYMY  WYQQKPGSSPRLLIY  DTSNLAS
P1B6            QIVLTQSPAIMSASPGEKVTMTC  SASSRV-------SYMH  WYQQKSGTSPKRWIY  DTSKLAS
P8G4

8D8             DIVMTQSQKFMSTSIGDRVSVTC  KASQNVG------TNVA  WYQQKPGQSPKALVY  STSYRYS
2A9             DIVMTQSQKFMSTSVGDRVSITC  KASQNVG------TAVA  WYQQKPGQSPKILIY  SASNRFT

8C10            DFVLTQSPATLSVTPGDSVSLSC  RASQSIS------NNLH  WYQQKSHESPRLLIK  YASQSIS
24G2            DILLTQSPAILSVSPGBRVSFSC  RASQSIG------TSIH  WYQQRTNGSPRLLIK  YASESIS

2023            DVVMTQTQPTLTLSVTLGQSASISC RSSQSLLDSDGKTYLN  WLLQRPGQSPKRLIY  LVSKVDS
6N16            DVVMTQTQAPLILSVTIGQPASISC KSSQSLLDGDGETYLS  WLLQRPGQSPKRLIY  LVSKLDS
5A20            DVVMTQTPLTLSVTIGHPASISC  KSSQSLLDFDGKTYLN  WLFQRPGQSPKRLFY  LVSKLDS
17J16           DVALHQIPLTLSVTVGQPASISC  KSSQSLSDSDGKTYLN  WLLQKPGQSPKRLIY  LVSRLGS
1A3             DIVMTQAAFSNPVTLGTSASISC  RSSKSLLHSNGITYLY  WYLQKPGQSPQLLIY  QMGNLAS
P1H8            DVLMTQTPLSLPVSLGDQASISC  RSSQTIVHSNGYTYLE  WYLQKPGQSPKLLIY  KVSNRFS

25M22           DVVLTQTPLSLPVNIGDQASISC  KSTKSLLNSDEFTYLD  WYLQKPGQSPQLLIF  LVSNRFS
19K19           DVVLTQTPLSLPVNIGDQASISC  KSTKSLLNSDEFTYLD  WYLQKPGQSPQLLIY  LVGNRFS

5F12            NIVLTQSPASLAVSLGQRATISC  RASESVDTYGN-SPMH  WYQQKPGQPPKRLLIY LASNLES
6G9             DIVLTQSPASLAVSLGQRATISC  RASESVDFSGN-SPMH  WYQQKPGQPPKLLIY  RASNLDS
```

FIG. 4B (continued)

```
Kabat     60        70        80              89------97
AbM       60        70        80              89------97
Chothia   60        70        80              91------96
Contact   60        70        80              89------96
IMGT    70        89                        105-----117
AHon    73        91                        107     138

1C1     GVPDRFSGSGSGTDFTLKISRVEAEDLGVYFC SQSTHVPPWT FGGGTKLEIK  (1852)
3P10    GVPKRFSGSGSGTDFSLNIHPMEEDDSAMYFC LQSKEVP-WT FGGGTKLEIK  (1853)
12A3    GIPSRFSGSRSGSDYSLTISSIESEDFVDYYC LQYASSP--YT FGGGTKVEIK  (1854)
1B3     GIPSRFSGSGSGRDYSFSISNLEPEDIATYYC LQYDNL--YT FGSGTKLEIK   (1855)
2B3     GIPSRFSGSGSGTFYSLTISSVEARDAADYYC HQWS----ST FGSGTKLEIK   (1856)
2B11    GVPSRFSGSGSGTDYSLTITNLEQEDIATYFC QQGNTLP-FT FGSGTKLEIK   (1857)
2B8     GVPSRFSGSGSGTHFSLKIMSLQPEDFGTYYC QHYYGYP-FT FGSGTKLEIK   (1858)
22N5    GVPSRFSGSGSGQDYSLTVSSLEYDDVGIYYC LQYVEFP-LT FGDGTKLELK   (1859)
P1B6    GVPVRFSGSGSGTFYSITISRMEAEDAATYYC QQWNSYP-PT FGGGTKLEIK   (1860)
P8O4    GVPARFSGSGSGTSYSLTISSMEAEDAATYYC QQWNNNP-PT FGAGTTLELK   (1861)

8D8     GVPDRFTGSGSGTDFTLTISNVQSEDLAEYFC HQYNSYP-LT FGAGTKLEIK   (1862)
2A9     GVPDRFTGSGSGTDFTLTISNMQSEDLADYFC QQYSSY--FT FGGGTKLELK   (1863)

8C10    GIPSRFSGSGSGTDFTLSINSVETEDFGVYFC QQSNSWP-HT FGGGTKLEIK   (1864)
24G2    GIPSRFSGSGSGTDFTLIINSVESERDIADYYC QQSNSWPTFT FGAGTKLELK   (1865)

2J23    GVPDRFTGSGSGTDFTLKISRVEAEDLGVYYC WQGTHFP-LT FGAGTKLELK   (1866)
6N16    GVPDRFTGSGSGTDFTLKISRVEAEDLGVYYC CQSTHFP-LT FGAGTKLELK   (1867)
5A20    GVPDRFTGSGSGTDFTLKISRVEAEDLGVYYC WQGTHFP-RT FGGGTKLEIK   (1868)
17O16   GVPDRFSGSGSADFTLKISRVEAEDLGVYYC WQGTHFP-QT FGGGTKLEIK    (1869)
1A3     GVPDRFSSSGSGTDFTLRISRVEAEDVGVYYC AQHLELT-WT FGGGTKLEIK   (1870)
P1H8    GVPDRFSGSGSGTDFTLKISRVEAEDLGVYYC FQGSHVP-WT FGGGTKLEIK    (1871)

25M22   GVPDRFSGSGSGTDFTLKISRVEAEDLGVYYC FQSNYLP-YT FGGGTKLEIK   (1872)
19K19   GVPDRFSGSGSGTDFTLKISRVEAEDLGVYYC FQSNYLP-YT FGGGTKLEIK   (1873)

5F12    GVPARFSGSGSRTDFTLIDFVEADDAATYYC HQNNEDP-PA FGGGTKLEIK    (1874)
6G9     GIPARFSGVGSRTDFTLINPVEADDVATYYC QQSNEDP-YT FGGGTKLEIB    (1875)
```

FIG. 5A

Domain 1 Binders
Antibody VH Domain

```
Kabat     1 ----------10        22                  31----35  40                                50--a-----60---65
AbM       1 ----------10        22    26-----35     40                                          50--a-----58    65
Chothia   1 ----------10        22    26-----32     40                                               a-55       65
Contact   1 ----------10        22          30---35 40                                          50--a-----58    65
IMGT      1 ----------10        23    27---38   41                                              56------65      74
AHon      1                     23    27       42                                               57              76

1A3     EVQLQQSGPELVKPGASVKISCKAS GYTFTDYYMN WVKQSHGKSLEWIG DIIPNNGVTSYNQKFKG
P1B6    EVQLQQSGPELVKPGASVKMSCKAS GYTFTDYYMN WVKQTHGKSLEWIG DINPNNGGPIYNQKFKG
P1H8    EVQLQQSGAEVVKPGASVKISCKAS GYTFTDYYMN WVKQSHGKSLEWIG DINPNNGGTTYNQKFKG
P8G4    QVQLKQSGPGLVQPSQSLSITCTVS GFSLTSYGVH WVRQSPGKGLDWLG VLW-SGGSTDYNAAFIS

Kabat     70           80  abc       90           95-------102      110
AbM       70           80  abc       90           95-------102      110
Chothia   70           80  abc       90           96----101         110
Contact   70           80  abc       90           93--------------117
IMGT     75            89             105 106 109                    138
AHon 1A3    KATLTVDKSSSTAYMELRSLTSEDSAVYYCAR EWLLRGMDY    WGQGTSVTVSS  (1876)
P1B6   KATLTVDKSSSTAYMELRSLTSEDSAVYYCAR SDSA-NFTY    WGQGTLVTVSA  (1877)
P1H8   KATLTVDKSSSTAYMELRSLTSEDSAVYYCAR QGPW-YFDV    WGTGTTVTVSS  (1878)
P8G4   RLSISKDNSKSQVFFKMNSLQADDTAIYYCAR N----FGDY    WGQGTSVTVSS  (1879)
```

FIG. 5B

```
Domain 1 Binders
Antibody VL Domain
Kabat      1          10          20          24-27abcde----34    40    50-----56
AbM        1          10          20          24----30abcde--34   40    50-----56
Chothia    1          10          20          26--30abcd-32       40    50---
Contact    1          10          20                    30abcde----36   40    46-------55
IMGT       1                              23          27--------38  41         56-65 69

AHon       1                              23                       42         58       72
1A3          DIVMTQAAPSNPVTLGTSASISC RSSKSLLHSNGITYLY WYLQKPGQSPQLLIY QMSNLAS
P1B6         QIVLTQSPAIMSASPGEKVTMTC SASSSV-----SYMY WYQQKPGSSPRLLIY DTSNLAS
P1H8         DVLMTQTPLSLPVSLGDQASISC RSSQTIVHSNGYTYLE WYLQKPGQSPKLLIY KVSNRFS
P8G4         QIVLTQSPAIMSASPGEKVTMTC SASSRV-----SYMH WYQQKSGTSPKRWIY DTSKLAS

Kabat       60          70          80          89------97
AbM         60          70          80          89------97
Chothia     60          70          80                91------96
Contact     60          70          80          89-----96
IMGT                        89                           105------117
AHon                  73    91                           107       138
1A3         GVPDRFSSSGSGTDFTLRISRVEAEDVGVYYC AQHLELTWT     FGGGTKLEIK (1880)
P1B6        GVPVRFSGSGSGTFYSITISRMEAEDAATYYC QQWNSYPPT    FGGGTKLEIK (1881)
P1H8        GVPDRFSGSGSGTDFTLKISRVEAEDLGVYYC FQGSHVPWT    FGGGTKLEIK (1882)
P8G4        GVPARFSGSGSGTSYSLTISSMEAEDAATYYC QQWNNNPPT    FGAGTTLELK (1883)
```

FIG. 5C

```
Domain 2 Binders
Antibody VH Domain
Kabat    1          10                        22            31---35        40           50--a----60---65
AbM      1          10                        22         26-----35         40           50--a------58    65
Chothia  1          10                        22         26----32          40                  a-55      65
Contact  1          10                        22            30---35        40        47----a----58       65
IMGT     1                                    23         27---38     41                        56------65 74
AHon     1                                    23         27          42                        57         76
1C1      QMQLKQSGPGLVQPSQSLSITCTVS GFSLNDYGVH WIRQSPGKGLEWLG VIW-SGGRTDYNAAFIS
2A9      EVKLVESGGGLVKPGGSLKLSCAAS GFTFPSTYAMS WVRQTPEKRLEWVA SIT-SGGTTYYTDSVKG
2J23     QAQLQQSGAELVKPGASVKLSCKAS GVSFTSYNID WVRQPEQGLEWIG WIFPGDGSTKYNEKFKG
5A20     QVQLQQSGPELMKPGASVILSCKAI GYTFTDYWIE WVKERPGHGLEWIG EILLGSDSIHFNEKFKG
8C10     QVQLQQSGVELARPGAAVKLSCKAS GYTFANYGLT WVKQRTGQGLEWIG ETYPGSGHTHYNEDFKG
8D8      QVQLKESGPGLVAPSQSLSITCTVS GFSLSRYSVH WVRQPPGKGLEWLG MIW-GFGSTDYNSALKS
12A3     QIQLVQSGPELKKPGETVKISCKAS GVPFTIYGMN WVEQAPGKGLKWMG WINTYSGVPTYADDFKG
17J16    QVQLQQSGAELAKPGASVKMSCKTS GYTFTDYWIH WVKQRPGQGLEWIG YINPNSNYAEYNQKFKV
25M22    QVQLQQSGPDLVKPGASVKISCKAS GYTFTSYWMN WMKQRPGKGLEWIG RIYPGDGDTNYNGKFKG
19K19    QVQLQQSGPDLVKPGASVKISCKAS GYAFTSYWMN WVKQRPGKGLEWIG RIYPGDGDTNYNGKFKG
22N5     QMQLVQSGPELKKPGEIVKISCKTS GYTFTDYSMH WVKKTPGKGFKWMG WINTETGEPTYADDFKG
```

FIG. 5C (continued)

```
Kabat     70              80  abc          90                95--100-------102
AbM       70              80  abc          90                95--100-------102
Chothia   70              80  abc          90                96--100-------101
Contact   70              80  abc          90                   --100-------101
IMGT            75                   89          93--------------------------117
AHon                                     105                                   138
                                         106 109
1C1   RLSISKDNSKSQVFFKMSSLQPNDTAIYYCAR WALYFLYGG--SMDY WGQGTSVTVSS (1884)
2A9   RFTISRDNARNILVLQMSSLRSHEDTAMYYCAR DGNFYYY----GMDY WGQGTSVTVSS (1885)
2J23  QATLTTDKSSSTTYIHLSRLITSEDSAVYFCAR SGIYYGS----HFVY WGQGTLVTVSA (1886)
5A20  KATISADTSSNTAYMQLSSLITTEDSAIYYCVR QDWNW------YFDV WGTGTTVTVSS (1887)
8C10  KATLTADRSSSTAYMELRSLTSEDSAVYFCAR RIQLLLPVG--GFVY WGQGTLVTVSA (1888)
8D8   RLSITKDNSKSQFFLKMNSLQTDDTAMYYCAR IHTT-------AGSY WGQGTLVTVSS (1889)
12A3  RFAFSLETSASTAYLQINNLKDEDTATYFCAS ATG--------NY  WGQGTTLTVSS (1890)
17J16 KATLTADKSSSTAYLQLSRLTSEDSAVYFCAR FDWNW------YFHV WGAGSTVTVSS (1891)
25M22 KATLTADKSSSTAYMQLSSLTSEDSAVYFCAR AYLLRLRRTGYYAMDY WGQGTSVTVSS (1892)
19K19 KATLTADKSSSTAYMQLSSLTSEDSAVYFCAR AYLLRLRRTGYYAMDY WGQGTSVTVSS (1893)
22N5  RFAFSLETSANTAHLQITNLKNEDTATYFCVK GTL--------NY  WGQGTTLTVSS (1894)
```

Domain 2 Binders
Antibody VL Domain

```
Kabat     1          10          20          23   24-27abcde----34        40   50------56
AbM       1          10          20          23   24----30abcde--34       40   50------56
Chothia   1          10          20          23   26--30abcd-32           40   50---
Contact   1          10          20          23        30abcde----36      40        46-----55
IMGT      1          10          20               27--------38   41            56-65   69
                                                                                  |-----|
                                                                                      58      72
AHon      1                                                       42
1C1       DVVLTQTPLSLPVSPGDQASISC RSSQSLVHSSGITYLH WYLQKPGQSPKLLIY KLSNRFS
2A9       DIVMTQSQKFMSTSVGDRVSLTC KASQNVG---TAVA  WYQQKPGQSPKILIY SASNRFT
2J23      DVVMTQTPLTLSVTIGQSASISC RSSQSLLDSDGKTYLN WLLQRPGQSPKRLIY LVSKVDS
5A20      DVVMTQTPLTLSVTIGHPASISC KSSQSLLDFDGKTYLN WLFQRPGQSPKRLFY LVSKLDS
8C10      DFVLTQSPATLSVTPGDSVSLSC RASQSIS----MNLH  WYQQKSHESPRLLIK YASQSIS
8D8       DIVMTQSQKFMSTSIGDRVSVTC KASQNVG----TNVA  WYQQKPGQSPKALVY STSYRYS
12A3      DIQMTQSPSSLSASLGERVSLTC RASQDIG----SSLN  WLQQEPDGTIKRLIY ATSSLDS
17J16     DVALTQIPLITLSVTVGQPASISC KSSQSLSDSDGKTYLN WLLQKPGQSPKRLIY LVSRLGS
25M22     DVVLTQTPLSLPVNIGDQASISC KSTKSLLNSDEFTYLD WYLQKPGQSPQLLIF LVSNRFS
19K19     DVVLTQTPLSLPVNIGDQASISC KSTKSLLNSDEFTYLD WYLQKPGQSPQLLIY LVSNRFS
22N5      DIKMTQSPSSMYASLGERVTITC KASQDIK----SYLN  WFQQKPGKSPKTLIY RTKRLVD
```

FIG. 5D (continued)

| | | | | | | | |
|---|---|---|---|---|---|---|---|
| Kabat | | 60 | | 70 | | 80 | 89-------97 |
| AbM | | 60 | | 70 | | 80 | 89-------97 |
| Chothia | | 60 | | 70 | | 80 | 91------96 |
| Contact | | 60 | | 70 | | | 89------96 |
| IMGT | 70 | | 89 | | | | 105-------117 |
| AHon | 73 | | 91 | | | | 107        138 |
| 1C1  | GVPDRFSGSGSGTDFTLKISRVEAEDLGVYFC | SQSTHVPPWT | FGGGTKLEIK | (1895) |
| 2A9  | GVPDRFTGSGSGTDFTLTISNMQSEDLADYFC | QQYSSY-FT  | FGGGTKLELK | (1896) |
| 2J23 | GVPDRPTGSGSGTDFTLKISRVEARDLGVYFC | WQGTHFP-LT | FGAGTKLELK | (1897) |
| 5A20 | GVPDRFSGSGSGTDFTLKISRVEAEDLGVYYC | WQGTHFP-RT | FGGGTKLEIK | (1898) |
| 8C10 | GIPSRFSGSGSGTDFTLSINSVETEDPGVYFC | QQSNSWP-HT | FGGGTKLEIK | (1899) |
| 8D8  | GVPDRFTGSGSGTDFTLTISNVQSEDLAEYFC | HQYNSYP-LT | FGAGTKLEIK | (1900) |
| 12A3 | GVPKRFSGSRSGSDYSLTISSLESEDFVDYYC | LQYASSP-YT | FGGGTKVEIK | (1901) |
| 17J16 | GVPDRFTGSGSGADFTLKISRVEAEDLGVYYC | WQGTHFP-QT | FGGGTKLEIK | (1902) |
| 25M22 | GVPDRFSGSGSGTDFTLKISRVEAEDLGVYYC | FQSNYLP-YT | FGGGTKLEIK | (1903) |
| 19K19 | GVPDRFSGSGSGTDFTLKISRVEAEDLGVYYC | FQSNYLP-YT | FGGGTKLEIK | (1904) |
| 22N5 | GVPSRFSGSGSGQDYSLTVSSLEYDDVGIYYC | LQYVEPP-LT | FGDGTKLELK | (1905) |

FIG. 5E

```
Domain 3 Binders
Antibody VH Domain
Kabat    1 ---- 10                           22 ----      31 ----- 35         40            50 --- a ----- 60 --- 65
AbM      1 ---- 10                           22 ---- 26 ----- 35              40            50 --- a ---- 58      65
Chothia  1 ---- 10                           22 ---- 26 ---- 32               40                  a - 55         65
Contact  1 ---- 10                           22 ----    30 ----- 35           40            50 --- a ----- 58     65
IMGT     1                                   23 ---- 27 ------ 38  41                             56 ----- 65     74
AHon     1                                   23 ---- 27        42                       47 ---- a ----- 58        76
1B3      QVHLQQPGAELVKPGASVKLSCKAS GFTFTG-YNIN WVRLRPEQGLEWIG WIFPGDDNAKYNEKFKG
2B11     DVQLQESGPGLVKPSQSLSLTCSVT GYSITSGYYWN WIRQFPGNKLEWMG HIA-NDGSNYYNPFLKH
3P10     QIQLVQSGPELKKPGETVKISCKAS GYTFTD-YGVI WVKQAPGKALKWMG WINTYTGEPTYADDLKG
5F12     QVQLKQSGTELVRPGASVKLSCKAS GYTFTD-YYIN WVKQRPGQGLEWIA RIYPGNGNTYHNEKFKG
6G9      QVQLHQPGAELVKPGASVKLSCKTS GYTFTS-YWMQ WVKQRPGQGLEWIG EIDPSDSYTNYNQKFKG
6N16     QVQLQQSGSELVKPGTSMKLSCKAS GYTFTS-YNIN WVRLRPEQGLEWIG WIFPGDDSIKYNENFRG Kabat    70 ---- 80  abc   89           90           95 --- 100 ----- 102           110
AbM      70 ---- 80  abc                90           95 --- 100 ----- 102           110
Chothia  70 ---- 80  abc                90           96 --- 100 ----- 101           110
Contact  70 ---- 80  abc                90           95 --- 100 ----- 101           110
IMGT     75                             90  93 ------------------- 117
AHon                                    105 106 109                138
1B3      KATLTTDKSSNTAYMQLSRLTSEDSAVYFCAR TPVLSN--YFDY WGQGTTLTVSS (1906)
2B11     RVSITRDTSKNQFFLKLNSVTIQDTATYYCAR GGSYFD---YVDY WGQGTTLTVSS (1907)
3P10     RFAFSLETSASSASLQINNLKNEDTATYFCAR RYGPE----DIDY WGQGTTLTVSS (1908)
5F12     KATLTAEKSSSTAYMQLSSLTSEDSAVYFCAR EGLYYDYDRYFDY WGQGTALTVSS (1909)
6G9      KATLTVDTSSTTAYMQLSSLTSEDSAVYYCAR PLDRSAY--YFDY WGQGTTLTVSS (1910)
6N16     KATLTTDKSSSTAYMHLSRLTSDDSAVYFCAR SGIPYGN--NFAY WGQGTLVTVSA (1911)
```

FIG. 5F

Domain 3 Binders
Antibody VL Domain

```
            1          10         20          24-27abcde----34        40       50-----56
Kabat       1          10         20          24----30abcde--34       40       50-----56
AbM         1          10         20          26--30abcd--32          40       50--
Chothia     1          10         20                30abcde-----36    40              46--------55
Contact     1                                   27-------38   41                       56-65 69
IMGT                   23          23                       42        58               72
AHon        1  DIQMTQSPSSLSASLGGKVTITC  KASQDIS------KYIS      WYQHKPGKSPRLLIH  YTSTLQP
1B3         1  DIQMTQTTSSLSASLGDRVTINC  RASQDIS------NVLN      WYQQKPDGTVKLLIY  YTSRLHS
2B11        1  DIVLTQSPVSLAVSLGQRATISC  RASESVDNYGI-SFMS        WFQQKPGQPPKLLIY  AASHQGS
3P10        1  NIVLTQSPASLAVSLGQRATISC  RASESVDTYGN-SFMH        WYQQKPGQPPKLLIY  LASNLES
5F12        1  DIVLTQSPASLAVSLGQRATISC  RASESVDFSGN-SFMH        WYQQKPGQPPKLLIY  RASNLDS
6G9         1  DVVMTQAPLILSVTIGQPASISC  KSSQSLLDGDGETVLS         WLLQRPGQSPKRLIY  LVSKLDS
```

```
            60          70       80              89--------97       105-----117
Kabat       60          70       80              89--------97       105-----117
AbM         60          70       80                 91-------96       107    138
Chothia     60          70       80              89--------96
Contact                  70 89
IMGT                    73 91
AHon
1B3   GIPSRFSGSGSGRDYSFSISNLEPEDIATYYC  LQYDNL-YT   FGGGTKLEIK (1912)
2B11  GVPSRFSGSGSGSTDYSLTITNLEQEDIATYFC  QQGNTLPFT  FGSGTKLEIK (1913)
3P10  GVPARFSGSGSGTDFSLNIHPMEEDSAMYFC   LQSKEVPWT   FGGGTKLEIK (1914)
5F12  GVPARFSGSGSRTDFTLTIDPVEADDAATYYC   HQNNEDPPA  FGGGTKLEIK (1915)
6G9   GIPARFSGVGSGTDFTLTINPVEADDVATYYC   QQSNEDPYT  FGGGTKLEIE (1916)
6N16  GVPDRFTGSGSGTDFTLKISRVEAEDLGVYYC   CQSTHFPLT  FGAGTKLELK (1917)
```

FIG. 6A
1C1 VH Domain

| | | | | | | | |
|---|---|---|---|---|---|---|---|
| Kabat | 1 | 10 | 22 | | 31----35 | 40 | 50-------60---65 |
| AbM | 1 | 10 | 22 | 26----- | ---35 | 40 | 50-------58 |
| Chothia | 1 | 10 | 22 | 26---32 | | 40 | -55 65 |
| Contact | 1 | 10 | 22 | | 30----35 | 40 | 47-------58 65 |
| IMGT | 1 | | 23 | 27--- | -38 41 | | 56-----65 74 |
| AHon | 1 | | 23 | 27 | 42 | | 57 76 |
| 1C1 | QMQLKQSGPGLVQPSQSLSITCTVS | GFSLNDYGVH | WIRQSPGKGLEWLG | VIWSGGRTDYNAAFIS |
| based on IGHV4-59/IGHJ1-1 | | | | |
| HC-349a | QVQLQESGPGLVKPSETLSLTCTVS | GFSLNDYGVH | WIRQPPGKGLEWIG | VIWSGGRTDYNAAFIS |
| HC-349b | QVQLQESGPGLVKPSETLSLTCTVS | GFSLNDYGVH | WIRQPPGKGLEWIG | VIWSGGRTDYNAAFIS |
| HC-349c | QMQLQESGPGLVKPSETLSLTCTVS | GFSLNDYGVH | WIRQPPGKGLEWIG | VIWSGGRTDYNAAFIS |
| HC-349d | QMQLQESGPGLVKPSETLSLTCTVS | GFSLNDYGVH | WIRQPPGKGLEWIG | VIWSGGRTDYNAAFIS |
| HC-349e | QMQLQESGPGLVKPSETLSLTCTVS | GFSLNDYGVH | WIRQPPGKGLEWIG | VIWSGGRTDYNAAFIS |
| HC-349f | QMQLQESGPGLVKPSETLSLTCTVS | GFSLNDYGVH | WIRQPPGKGLEWLG | VIWSGGRTDYNAAFIS |
| HC-350a | QVQLQESGPGLVKPSETLSLTCTVS | GFSLNDYGVH | WIRQPPGKGLEWIG | VIWSGGRTDYNAAFIS |
| HC-350b | QMQLQESGPGLVKPSETLSLTCTVS | GFSLNDYGVH | WIRQPPGKGLEWIG | VIWSGGRTDYNAAFIS |
| HC-350c | QMQLQESGPGLVKPSETLSLTCTVS | GFSLNDYGVH | WIRQPPGKGLEWIG | VIWSGGRTDYNAAFIS |

FIG. 6A (continued)
1C1 VH Domain

```
Kabat              70                  80  abc            90              95--100----102
AbM                70                  80  abc            90              95--100----102       110
Chothia            70                  80  abc            90              96-100---101        110
Contact            70                  80  abc            90              95--100---101       110
IMGT       75                               89                                                 110
AHon                                                            105------------117
1C1        RLSISKDNSKSQVFFKMSSLQPNDTAIYYCAR    106 109    WALYFLYGGSMDY    138                WGQGTSVTVSS  (1918)
based on IGHV4-59/IGHJ1-1
HC-349a    RVTISVDTSKNQFSLKLSSVTAADTAVYYCAR                    WALYFLYGGSMDY                  WGQGTLVTVSS  (1919)
HC-349b    RVTISKDTSKNQFSLKLSSVTAADTAVYYCAR                    WALYFLYGGSMDY                  WGQGTLVTVSS  (1920)
HC-349c    RLTISVDTSKNQVSLKLSSVQAADTAVYYCAR                    WALYFLYGGSMDY                  WGQGTLVTVSS  (1921)
HC-349d    RVTISKDNSKSQFSLKLSSVTAQDTAVYYCAR                    WALYFLYGGSMDY                  WGQGTLVTVSS  (1922)
HC-349e    RLTISKDTSKNQFSLKMSSVTAADTAVYYCAR                    WALYFLYGGSMDY                  WGQGTLVTVSS  (1923)
HC-349f    RLTISKDTSKNQVSFKMSSLTAADTAVYYCAR                    WALYFLYGGSMDY                  WGQGTLVTVSS  (1924)
HC-350a    RVTISRDTSKNQFSLKLSSVTAADTAVYYCAR                    WALYFLYGGSMDY                  WGQGTLVTVSS  (1925)
HC-350b    RVTISRDTSKSQFSLKLSSVTAADTAVYYCAR                    WALYFLYGGSMDY                  WGQGTLVTVSS  (1926)
HC-350c    RLTISRDTSKSQVSFKLSSVTAADTAVYYCAR                    WALYFLYGGSMDY                  WGQGTLVTVSS  (1927)
```

FIG. 6B
1C1 VL Domain

```
Kabat      1            10           20            24-27abcde----34         40                        50-----56
AbM        1            10           20            24----30abcde--34        40                        50-----56
Chothia    1            10           20            26--30abcd-32            40                        50-----55
Contact    1            10           20                  30abcde----36      40         46-----------56-65 69
IMGT       1                                       27------38      41                                           |---|

AHon       1                                                       42                                 58       72
1C1        DVVLTQTPLSLPVSPGDQASISC RSSQSLVHSSGITYLH WYLQKPGQSPKLLIY KLSNRFS
based on IGKV2-30/IGKJ4-1
LC-349a    DVVMTQSPLSLPVTLGQPASISC RSSQSLVHSSGITYLH WFQQRPGQSPRRLIY KLSNRFS
LC-349b    DVVLTQSPLSLPVTLGQPASISC RSSQSLVHSSGITYLH WYQQRPGQSPRRLIY KLSNRFS
LC-349c    DVVLTQSPLSLPVTLGQPASISC RSSQSLVHSSGITYLH WYQQRPGQSPKLLIY KLSNRFS
LC-349d    DVVLTQSPLSLPVTLGDPASISC RSSQSLVHSSGITYLH WYQQKPGQSPKLLIY KLSNRFS
LC-350a    DVVLTQTPLSLPVSPGDQASISC RSSQSLVHSSGITYLH WYLQKPGQSPKLLIY KLSNRFS
LC-350b    DIVMTQTPLSLPVSPGDQASISC RSSQSLVHSSGITYLH WYLQKPGQSPKLLIY KLSNRFS
```

FIG. 6B (continued)
1C1 VL Domain

```
Kabat            60              70              80              89-------97
AbM              60              70              80              89-------97
Chothia          60              70              80              91-----96
Contact          60              70              80              89-----96
IMGT                     70              89                         105------117
AHon                     73              91                         107    138
1C1              GVPDRFSGSGSGTDFTLKISRVEAEDLGVYFC SQSTHVPPWT FGGGTKLEIK   (1928)
based on IGKV2-30/IGKJ4-1
LC-349a          GVPDRFSGSGSGTDFTLKISRVEAEDVGVYYC SQSTHVPPWT FGGGTKVEIK   (1929)
LC-349b          GVPDRFSGSGSGTDFTLKISRVEAEDVGVYYC SQSTHVPPWT FGGGTKVEIK   (1930)
LC-349c          GVPDRFSGSGSGTDFTLKISRVEAEDVGVYYC SQSTHVPPWT FGGGTKVEIK   (1931)
LC-349d          GVPDRFSGSGSGTDFTLKISRVEAEDVGVYYC SQSTHVPPWT FGGGTKVEIK   (1932)
LC-350a          GVPDRFSGSGSGTDFTLKISRVEAEDLGVYFC SQSTHVPPWT FGGGTKLEIK   (1933)
LC-350b          GVPDRFSGSGSGTDFTLKISRVEAEDLGVYFC SQSTHVPPWT FGGGTKLEIK   (1934)
```

FIG. 7A
25M22 VH Domain

```
                                                                              31---35    40           50--a-----60---65
Kabat         1              10           22                  26----35        40                      50--a-----58
AbM           1              10           22              26----32            40                         a-55
Chothia       1              10           22                   30----35       40                      50--a-----58
Contact       1              10           22              27-----38   41                           47-----a-----65
IMGT          1              10           23                   27           42                               56-----65
AHon          1              10           23
25M22             QVQLQQSGPDLVKPGASVKISCKAS GYTFTSYWVN WMKQRPGKGLEWIG RIYPGDGDTNYNGKFKG                        57
based on IGHV5-51/IGHJ6
HC-389a           EVQLVQSGAEVKKPGESLKISCKGS GYTFTSYWVN WVRQMPGKGLEWIG RIYPGDGDTNYNGKFKG
HC-389b           EVQLVQSGAEVKKPGESLKISCKGS GYTFTSYWVN WVRQMPGKGLEWIG RIYPGDGDTNYNGKFKG
HC-389c           EVQLVQSGAEVKKPGESLKISCKGS GYTFTSYWVN WVRQMPGKGLEWIG RIYPGDGDTNYNGKFKG
based on IGHV1-69/IGHJ6
HC-390a           QVQLVQSGAEVKKPGSSVKVSCKAS GYTFTSYWVN WVRQAPGQGLEWMG RIYPGDGDTNYNGKFKG
HC-390b           QVQLVQSGAEVKKPGSSVKVSCKAS GYTFTSYWVN WVRQAPGQGLEWIG RIYPGDGDTNYNGKFKG
HC-390c           QVQLVQSGAEVKKPGSSVKVSCKAS GYTFTSYWVN WVRQAPGQGLEWIG RIYPGDGDTNYNGKFKG
```

25M22 VH Domain

```
Kabat               70            80 abc         90              95--100-------102
AbM                 70            80 abc         90              95--100-------102       110
Chothia             70            80 abc         90              96-100--------101       110
Contact             70            80 abc         90              95--100-------101       110
IMGT             75                  89                        93--------------117       110
AHon                                                     105----------------------138
                                                         106 109
25M22           KATLTADKSSSTAYMQLSSLTSEDSAVYFCAR AYLLRLRRTGYYAMDY WGQGTSVTVSS    (1935)
based on IGHV5-51/IGHJ6
HC-389a         QVTISADKSISTAYLQWSSLKASDTAMYYCAR AYLLRLRRTGYYAMDY WGQGTTVTVSS    (1936)
HC-389b         QATISADKSISTAYLQWSSLKASDTAMYYCAR AYLLRLRRTGYYAMDY WGQGTTVTVSS    (1937)
HC-389c         QATLSADKSISTAYLQWSSLKASDTAMYYCAR AYLLRLRRTGYYAMDY WGQGTTVTVSS    (1938)
based on IGHV1-69/IGHJ6
HC-390a         RVTITADESTSTAYMELSSLRSEDTAVYYCAR AYLLRLRRTGYYAMDY WGQGTTVTVSS    (1939)
HC-390b         RATITADESTSTAYMELSSLRSEDTAVYYCAR AYLLRLRRTGYYAMDY WGQGTTVTVSS    (1940)
HC-390c         RATLTADKSTSTAYMELSSLRSEDTAVYYCAR AYLLRLRRTGYYAMDY WGQGTTVTVSS    (1941)
```

FIG. 7B
25M22 VL Domain

```
Kabat       1           10           20           24-27abcde----34              40       50-----56
AbM         1           10           20           24----30abcde--34             40       50-----56
Chothia     1           10           20           26--30abcd-32                 40       50---
Contact     1           10           20              30abcde----38                       46-----55
IMGT        1                                    27---------38       41                     56-65 69

AHon        1                                23                       42                     58        72
25M22       DVVLTQTPLSLPVNIGDQASISC          KSTKSLLNSDEFTYLD         WVLQKPGQSPQLLIF         LVSNRFS
based on IGKV2-30/IGKJ4
LC-389a     DVVMTQSPLSLPVTLGQPASISC          KSTKSLLNSDEFTYLD         WFQQRPGQSPRLLIY         LVSNRFS
LC-389b     DVVLTQSPLSLPVTLGQPASISC          KSTKSLLNSDEFTYLD         WFQQRPGQSPRLLIY         LVSNRFS
LC-389c     DVVLTQSPLSLPVTLGQPASISC          KSTKSLLNSDEFTYLD         WYQQRPGQSPRLLIF         LVSNRFS
based on IGKV3-20/IGKJ4
LC-390a     EIVLTQSPGTLSLSPGERATLSC          KSTKSLLNSDEFTYLD         WYQQKPGQAPRLLIY         LVSNRFS
LC-390b     EVVLTQSPGTLSLSPGERATLSC          KSTKSLLNSDEFTYLD         WYQQKPGQAPRLLIF         LVSNRFS
```

FIG. 7B (continued)
25M22 VL Domain

| | | | | | | |
|---|---|---|---|---|---|---|
| Kabat | 60 | 70 | 80 | 89------97 | | |
| AbM | 60 | 70 | 80 | 89------97 | | |
| Chothia | 60 | 70 | 80 | 91----96 | | |
| Contact | 60 | 70 | 80 | 89-----96 | | |
| IMGT | 70 | 89 | | 105------117 | | |
| AHon | 73 | 91 | | 107 138 | | |
| 25M22 | GVPDRFSGSGSGTDFTLKISRVEAEDLGVYYC | FQSNYLPYT | FGGGTKLEIK | (1942) |
| based on IGKV2-30/IGKJ4 | | | | | | |
| LC-389a | GVPDRFSGSGSGTDFTLKISRVEAEDVGVYYC | FQSNYLPYT | FGGGTKVEIK | (1943) |
| LC-389b | GVPDRFSGSGSGTDFTLKISRVEAEDVGVYYC | FQSNYLPYT | FGGGTKVEIK | (1944) |
| LC-389c | GVPDRFSGSGSGTDFTLKISRVEAEDVGVYYC | FQSNYLPYT | FGGGTKVEIK | (1945) |
| based on IGKV3-20/IGKJ4 | | | | | | |
| LC-390a | GIPDRFSGSGSGTDFTLTISRLEPEDFAVYYC | FQSNYLPYT | FGGGTKVEIK | (1946) |
| LC-390b | GIPDRFSGSGSGTDFTLTISRLEPEDFAVYYC | FQSNYLPYT | FGGGTKVEIK | (1947) |

FIG. 8A
17J16 VH Domain

```
Kabat       1          10                   22             31-----35   40                         50--a------60---65
AbM         1          10                   22          26-----------35 40                         50--a------58   65
Chothia     1          10                   22          26--------32   40                                a-55      65
Contact     1          10                   22             30----35   40                         47-----------a----58   65
IMGT        1                                23          27-----38  41                            56------65       74
AHon        1                                23          27         42                            57               76
17J16          QVQLQQSGAELAKPGASVKMSCKTS GYTFTDYWIH WVKQRPGQGLEWIG YINPNSNYAEYNQKFKV
based on IGHV1-69/IGHJ6
HC-356a        QVQLVQSGAEVKKPGSSVKVSCKAS GYTFTDYWIH WVRQAPGQGLEWIG YINPNSNYAEYNQKFKV        (1948)
HC-356b        QVQLVQSGAEVKKPGSSVKVSCKAS GYTFTDYWIH WVRQAPGQGLEWIG YINPNSNYAEYNQKFKV        (1949)
HC-356c        QVQLVQSGAEVKKPGSSVKVSCKAS GYTFTDYWIH WVRQAPGQGLEWIG YINPNSNYAEYNQKFKV        (1950)
HC-356d        QVQLVQSGAEVKKPGSSVKVSCKAS GYTFTDYWIH WVKQAPGQGLEWIG YINPNSNYAEYNQKFKV        (1951)
                                                                                             (1952)

Kabat          70              80   abc       90        95-----102           110
AbM            70              80   abc       90        95-----102           110
Chothia        70              80   abc       90        96-----101           110
Contact        70              80   abc       90        93-----101           110
IMGT       75                  89             90   105-----------117
AHon                                               106 109            138
17J16          KATLTADKSSSTAYLQLSRLTSEDSAVYYCAR FDWNWYFHV WGAGSTVTVSS
based on IGHV1-69/IGHJ6
HC-356a        RVTITADESTSTAYMELSSLRSEDTAVYYCAR FDWNWYFHV WGQGTTVTVSS         (1949)
HC-356b        RVTITADESTSTAYMELSSLRSEDTAVYYCAR FDWNWYFHV WGQGTTVTVSS         (1950)
HC-356c        RATLTADESTSTAYLELSRLRSEDTAVYYCAR FDWNWYFHV WGQGTTVTVSS         (1951)
HC-356d        RATLTADESSSTAYLELSRLRSEDTAVYYCAR FDWNWYFHV WGQGTTVTVSS         (1952)
```

FIG. 8B
17J16 VL Domain

```
Kabat     1            10           20           24-27abcde----34              40              50-----56
AbM       1            10           20           24-----30abcde--34            40              50-----56
Chothia   1            10           20           26--30abcd-32                 40              50---
Contact   1            10           20                        30abcde----36    40              46-----55
IMGT      1                                      27-------38      41                           56-65  69

AHon                   23                           23           42                            58     72
17J16 b1       DVALTQIPLTLSVTVGQPASISC KSSQSLSDSDGKTYLN WLLQKPGQSPRRLIY LVSRLGS
based on IGKV2-30/IGKJ4
LC-356a        DVVMTQSPLSLPVTLGQPASISC KSSQSLSDSDGKTYLN WFQQRPGQSPRRLIY LVSRLGS
LC-356b        DVVLTQSPLSLPVTLGQPASISC KSSQSLSDSDGKTYLN WLQQRPGQSPRRLIY LVSRLGS
LC-356c        DVALTQSPLSLPVTLGQPASISC KSSQSLSDSDGKTYLN WLQQRPGQSPKRLIY LVSRLGS Kabat          60           70           80           89-----97
AbM            60           70           80           89-----97
Chothia        60           70           80              91---96
Contact        60           70           80           89-----96
IMGT                                89                        105-----117
AHon           70          91                                  107       138
17J16          GVPDRFTGSGSGSGADFTLKISRVEAEDLGVYYC WQGTHFPQT     FGGGTKLEIK  (1953)
based on IGKV2-30/IGKJ4
LC-356a        GVPDRFSGSGSGTDFTLKISRVEAEDVGVYYC  WQGTHFPQT     FGGGTKVEIK  (1954)
LC-356b        GVPDRFSGSGSGTDFTLKISRVEAEDVGVYYC  WQGTHFPQT     FGGGTKVEIK  (1955)
LC-356c        GVPDRFSGSGSGADFTLKISRVEAEDVGVYYC  WQGTHFPQT     FGGGTKVEIK  (1956)
```

FIG. 9A
5F12 VH Domain

| | | | | | | | |
|---|---|---|---|---|---|---|---|
| Kabat | 1 | 10 | 22 | | 31-----35 | 40 | 50--a-----60---65 |
| AbM | 1 | 10 | 22 | 26-----35 | | 40 | 50--a-----58  65 |
| Chothia | 1 | 10 | 22 | 26----32 | | 40 | a-55  65 |
| Contact | 1 | 10 | 22 | | 30-----35 | 40 | 47-------a--58  65 |
| IMGT | 1 | | 23 | 27------38 | 41 | | 56-----65  74 |
| AHon | 1 | | 23 | 27 | 42 | | 57  76 |
| 5F12 | QVQLKQSGTELVRPGASVKLSCKAS | | | GYTFTDYYIN | | WVKQRPGQGLEWIA | RIYPGNGNTYHNEKFKG |
| based on IGHV1-69/IGHJ1-1 | | | | | | | |
| HC-375a | QVQLVQSGAEVKKPGSSVKVSCKAS | | | GYTFTDYYIN | | WVRQAPGQGLEWMG | RIYPGNGNTYHNEKFKG |
| HC-375b | QVQLVQSGAEVKKPGSSVKVSCKAS | | | GYTFTDYYIN | | WVRQAPGQGLEWIG | RIYPGNGNTYHNEKFKG |
| HC-375c | QVQLVQSGAEVKKPGSSVKVSCKAS | | | GYTFTDYYIN | | WVRQAPGQGLEWIG | RIYPGNGNTYHNEKFKG |
| HC-375d | QVQLVQSGAEVKKPGSSVKVSCKAS | | | GYTFTDYYIN | | WVRQAPGQGLEWMG | RIYPGNGNTYHNEKFKG |
| HC-375e | QVQLVQSGAEVKKPGSSVKVSCKAS | | | GYTFTDYYIN | | WVRQAPGQGLEWMG | RIYPGNGNTYHNEKFKG |
| HC-375f | QVQLVQSGAEVKKPGSSVKVSCKAS | | | GYTFTDYYIN | | WVKQAPGQGLEWIG | RIYPGNGNTYHNEKFKG |
| HC-375g | QVQLVQSGAEVKKPGSSVKVSCKAS | | | GYTFTDYYIN | | WVRQAPGQGLEWIA | RIYPGNGNTYHNEKFKG |
| based on IGHV1-3/IGHJ1-1 | | | | | | | |
| HC-375h | QVQLVQSGAEVKKPGASVKVSCKAS | | | GYTFTDYYIN | | WVRQAPGQRLEWIA | RIYPGNGNTYHNEKFKG |

FIG. 9A (continued)
5F12 VH Domain

```
Kabat              70              80  abc         90           95--100---102         110
AbM                70              80  abc         90           95--100---102         110
Chothia            70              80  abc         90           96-100---101          110
Contact            70              80  abc         90           95--100---101         110
IMGT       75                      89                  105---------------117
AHon                                            106 109                  138
5F12          KATLTAEKSSSTAYMQLSSLITSEDSAVYFCAR EGLYVDYDRYFDY WGQGTALTVSS (1957)
based on IGHV1-69/IGHJ1-1
HC-375a       RVTITADESTSTAYMELSSLRSEDTAVYYCAR EGLYVDYDRYFDY WGQGTLVTVSS (1958)
HC-375b       RVTITADESTSTAYMELSSLRSEDTAVYYCAR EGLYVDYDRYFDY WGQGTLVTVSS (1959)
HC-375c       RVTITADKSTSTAYMELSSLRSEDTAVYYCAR EGLYVDYDRYFDY WGQGTLVTVSS (1960)
HC-375d       RATLTADKSTSTAYMELSSLRSEDTAVYYCAR EGLYVDYDRYFDY WGQGTLVTVSS (1961)
HC-375e       RATLTADKSTSTAYMELSSLRSEDTAVYYCAR EGLYVDYDRYFDY WGQGTLVTVSS (1962)
HC-375f       RATLTADKSTSTAYMELSSLRSEDTAVYYCAR EGLYVDYDRYFDY WGQGTLVTVSS (1963)
HC-375g       RATLTADKSTSTAYMELSSLRSEDTAVYYCAR EGLYVDYDRYFDY WGQGTLVTVSS (1964)
based on IGHV1-3/IGHJ1-1
HC-375h       RATLTRDKSASTAYMELSSLRSEDTAVYYCAR EGLYVDYDRYFDY WGQGTLVTVSS (1965)
```

FIG. 9B
5F12 VL Domain

```
Kabat     1               10                  20               24-27abcd----34              40                      50-----56
AbM       1               10                  20               24-----30abcd--34            40                      50-----56
Chothia   1               10                  20               26--30abcd32                 40                      50---
Contact   1               10                  20                                            40              46-----55
IMGT      1                                                    30abcd-----36                                    56-65 69
                                                   23          27------38    41                                58           72

AHon      1
5F12          NIVLTQSPASLAVSLGQRATISC   RASESVDTYGNSFMH   WYQQKPGQPPKLLIY   LASNLES
based on IGKV4-1/IGKJ4-1
LC-375a       DIVMTQSPDSLAVSLGERATINC   RASESVDTYGNSFMH   WYQQKPGQPPKLLIY   LASNLES
LC-375b       DIVLTQSPDSLAVSLGERATINC   RASESVDTYGNSFMH   WYQQKPGQPPKLLIY   LASNLES
LC-375g       DIVLTQSPDSLAVSLGERATINC   RASESVDTYGNSFMH   WYQQKPGQPPKLLIY   LASNLES
based on IGKV1-39/IGKJ4-1
LC-375c       DIQMTQSPSSLSASVGDRVTITC   RASESVDTYGNSFMH   WYQQKPGKAPKLLIY   LASNLES
LC-375d       DIQLTQSPSSLSASVGDRVTITC   RASESVDTYGNSFMH   WYQQKPGKAPKLLIY   LASNLES
based on IGKV3-11/IGKJ4-1
LC-375e       EIVLTQSPATLSLSPGERATLSC   RASESVDTYGNSFMH   WYQQKPGQAPRLLIY   LASNLES
LC-375f       EIVLTQSPATLSVSPGERATLSC   RASESVDTYGNSFMH   WYQQKPGQAPRLLIY   LASNLES
based on IGKV2-30/IGKJ4-1
LC-375h       DVVMTQSPLSLPVTLGQPASISC   RASESVDTYGNSFMH   WFQQRPGQSPRRLIY   LASNLES
LC-375i       DVVLTQSPLSLPVTLGQPASISC   RASESVDTYGNSFMH   WFQQRPGQSPRLLIY   LASNLES
LC-375j       DIVLTQSPLSLPVTLGQPASISC   RASESVDTYGNSFMH   WYQQRPGQSPRRLIY   LASNLES
```

FIG. 9B (continued)

5F12 VL Domain

```
Kabat          60                    70             80                  89------97        (1966)
AbM            60                    70             80                  89------97        (1967)
Chothia        60                    70             80                       91---96      (1968)
Contact        60                    70             80                  89------96        (1969)
IMGT       70                    89                                105-------117          (1970)
AHon       73                    91                                107      138           (1971)
5F12        GVPARFSGSGSGSRTDFTLTIDPVEADDAATYYC HQNNEDPPA PGGGTKLEIK          (1966)
based on IGKV4-1/IGKJ4-1
LC-375a     GVPSRFSGSGSGSGTDFTLTISSLQAEDVAVYYC HQNNEDPPA PGGGTKVEIK         (1967)
LC-375b     GVPDRFSGSGSGTDFTLTISSVQAEDVAVYYC   HQNNEDPPA PGGGTKVEIK         (1968)
LC-375g     GVPDRFSGSGSRTDFTLTISSLQAEDVAVYYC   HQNNEDPPA PGGGTKVEIK         (1969)
based on IGKV1-39/IGKJ4-1
LC-375c     GVPSRFSGSGSGTDFTLTISSLQPEDFATYYC   HQNNEDPPA PGGGTKVEIK         (1970)
LC-375d     GVPSRFSGSGSGTDFTLTISSVQPEDFATYYC   HQNNEDPPA PGGGTKVEIK         (1971)
based on IGKV3-11/IGKJ4-1
LC-375e     GIPARFSGSGSGTDFTLTISSLEPEDFAVYYC   HQNNEDPPA PGGGTKVEIK         (1972)
LC-375f     GVPARFSGSGSGTDFTLTISSVEPEDFAVYYC   HQNNEDPPA PGGGTKVEIK         (1973)
based on IGKV2-30/IGKJ4-1
LC-375h     GVPDRFSGSGSGSGTDFTLKISRVEAEDVGVYYC HQNNEDPPA PGGGTKVEIK         (1974)
LC-375i     GVPDRFSGSGSGTDFTLKISRVEAEDVGVYYC   HQNNEDPPA PGGGTKVEIK         (1975)
LC-375j     GVPDRFSGSGSRTDFTLKISRVEAEDVGVYYC   HQNNEDPPA PGGGTKVEIK         (1976)
```

FIG. 10A
3P10 VH Domain

| | | | | | | | | | |
|---|---|---|---|---|---|---|---|---|---|
| Kabat | 1 | | 10 | | 22 | | 31-----35 | 40 | 50--a-----60---65 |
| AbM | 1 | | 10 | | 22 | | 26-----35 | 40 | 50--a-----58 |
| Chothia | 1 | | 10 | | 22 | | 26----32 | 40 | a--55 |
| Contact | 1 | | 10 | | 22 | | 30---35 | 40 | a-----58 |
| IMGT | 1 | | | | 23 | | 27-----38 41 | | 56-----65 |
| AHon | 1 | | | | 23 | | 27 42 | | 57 |
| 3P10 | QIQLVQSGPELKKPGETVKISCKAS | | | | | | GYTFTDYGVI | WVKQAPGKGLKWMG | WINTYTGEPTYADDLKG |
| based on IGHV1-69/IGHJ6-1 | | | | | | | | | |
| HC-344a | QVQLVQSGAEVKKPGSSVKVSCKAS | | | | | | GYTFTDYGVI | WVRQAPGQGLEWMG | WINTYTGEPTYADDLKG |
| HC-344b | QIQLVQSGAEVKKPGSSVKVSCKAS | | | | | | GYTFTDYGVI | WVRQAPGQGLEWMG | WINTYTGEPTYADDLKG |
| HC-344c | QIQLVQSGAEVKKPGSSVKVSCKAS | | | | | | GYTFTDYGVI | WVRQAPGQGLEWMG | WINTYTGEPTYADDLKG |
| HC-344d | QIQLVQSGAEVKKPGSSVKVSCKAS | | | | | | GYTFTDYGVI | WVRQAPGQGLKWMG | WINTYTGEPTYADDLKG |
| HC-344e | QVQLVQSGAEVKKPGSSVKVSCKAS | | | | | | GYTFTDYGVI | WVRQAPGQGLEWMG | WINTYTGEPTYADDLKG |
| HC-344f | QVQLVQSGAEVKKPGSSVKVSCKAS | | | | | | GYTFTDYGVI | WVRQAPGQGLEWMG | WINTYTGEPTYADDLKG |
| HC-344g | QVQLVQSGAEVKKPGSSVKVSCKAS | | | | | | GYTFTDYGVI | WVRQAPGQGLKWMG | WINTYTGEPTYADDLKG |
| HC-344h | QIQLVQSGAEVKKPGSSVKVSCKAS | | | | | | GYTFTDYGVI | WVRQAPGQGLKWMG | WINTYTGEPTYADDLKG |
| HC-345a | QVQLVQSGAEVKKPGATVKISCKVS | | | | | | GYTFTDYGVI | WMQQAPGKGLEWIG | WINTYTGEPTYADDLKG |
| HC-345b | QIQLVQSGAEVKKPGATVKISCKVS | | | | | | GYTFTDYGVI | WMQQAPGKGLEWIG | WINTYTGEPTYADDLKG |
| HC-345c | QIQLVQSGAEVKKPGATVKISCKVS | | | | | | GYTFTDYGVI | WMQQAPGKGLEWIG | WINTYTGEPTYADDLKG |

FIG. 10A (continued)
3P10 VH Domain

```
Kabat          70              80  abc          90              95-----102           110
AbM            70              80  abc          90              95-----102           110
Chothia        70              80  abc          90              96-----101           110
Contact        70              80  abc          90              96-----101           110
IMGT      75                       89                      105-----------117
AHon                                           106 109                   138
3P10      RPAFSLETSASSASLQINNLKNEDTATYFCAR RYGPEDIDY WGQGTTLTVSS  (1977)
based on IGHV1-69/IGHJ6-1
HC-344a   RVTITADESTSTAYMELSSLRSEDTAVYYCAR RYGPEDIDY WGQGTTVTVSS  (1978)
HC-344b   RFTITLDESTSTAYMELSSLRSEDTAVYYCAR RYGPEDIDY WGQGTTVTVSS  (1979)
HC-344c   RFTFTLDESTSTAYMELSSLRSEDTAVYYCAR RYGPEDIDY WGQGTTVTVSS  (1980)
HC-344d   RVTFTLDESTSTAYMELSNLRSEDTAVYFCAR RYGPEDIDY WGQGTTVTVSS  (1981)
HC-344e   RVTFTADESTSTAYMELSSLRSEDTAVYYCAR RYGPEDIDY WGQGTTVTVSS  (1982)
HC-344f   RVTITADESTSTAYMELSSLRSEDTAVYYCAR RYGPEDIDY WGQGTTVTVSS  (1983)
HC-344g   RVTFTADESTSTAYMELSSLRSEDTAVYYCAR RYGPEDIDY WGQGTTVTVSS  (1984)
HC-344h   RVTFTADESTSTAYMELSSLRSEDTAVYFCAR RYGPEDIDY WGQGTTVTVSS  (1985)
HC-345a   RVTLTADTSTDTAYMELSSLRSEDTAVYFCAR RYGPEDIDY WGQGTMVTVSS  (1986)
HC-345b   RFTFTADTSTDTAYLELSSLRSEDTAVYFCAR RYGPEDIDY WGQGTMVTVSS  (1987)
HC-345c   RFTFTADTSTDTAYLELSSLRSEDTAVYFCAR RYGPEDIDY WGQGTMVTVSS  (1988)
```

FIG. 10B
3P10 VL Domain

```
Kabat     1          10          20           24-27abcd----34          40                 50-----56
AbM       1          10          20           24----30abcd--34         40                 50-----56
Chothia   1          10          20           26--30abcd32             40                 50--
Contact   1          10          20                                    40       46------55
IMGT      1                                   27-------38              41                 56-65 69
                                                                                               |
AHon      1                  23               42                                           58        72
3P10          DIVLTQSPVSLAVSLGQRATISC RASESVDNYGISFMS WFQQKPGQPPKLLIY AASHQGS
based on IGKV2-30/IGKJ4-1
LC-344a       DVVMTQSPLSLPVTLGQPASISC RASESVDNYGISFMS WFQQRPGQSPRRLIY AASHQGS
LC-344b       DIVLTQSPLSLPVTLGQPASISC RASESVDNYGISFMS WFQQRPGQSPRLLIY AASHQGS
LC-344c       DIVLTQSPLSLPVTLGQPASISC RASESVDNYGISFMS WFQQRPGQSPRLLIY AASHQGS
LC-344d       DIVMTQSPLSLPVTLGQPASISC RASESVDNYGISFMS WFQQRPGQSPRLLIY AASHQGS
LC-344e       DVVLTQSPLSLPVTLGQPASISC RASESVDNYGISFMS WFQQRPGQSPRLLIY AASHQGS
LC-344f       DVVMTQSPLSLPVTLGQPASISC RASESVDNYGISFMS WFQQRPGQSPRLLIY AASHQGS
LC-344g       DVVMTQSPLSLPVTLGQPASISC RASESVDNYGISFMS WFQQRPGQSPRLLIY AASHQGS
LC-344h       DVVLTQSPLSLPVTLGQPASISC RASESVDNYGISFMS WFQQRPGQSPRLLIY AASHQGS
LC-344i       DVVLTQSPLSLPVTLGQPASISC RASESVDNYGISFMS WYQQKPGQPPKLLIY AASHQGS
LC-345a       DIELTQSPASLAVSLGQRATISC RASESVDNYGISFMS WYQQKPGQPPKLLIY AASHQGS
LC-345b       DIVLTQSPASLAVSLGQRATISC RASESVDNYGISFMS WYQQKPGQPPKLLIY AASHQGS
```

FIG. 10B (continued)
3P10 VL Domain

| | | | | | | | |
|---|---|---|---|---|---|---|---|
| Kabat | | 60 | 70 | | 80 | 89------97 | |
| AbM | | 60 | 70 | | 80 | 89------97 | |
| Chothia | | 60 | 70 | | 80 | 91-----96 | |
| Contact | | 60 | 70 | | 80 | 89-----96 | |
| IMGT | 70 | | 89 | | | 105-------117 | |
| AHon | 73 | | 91 | | | 107 138 | |
| 3P10 | | GVPARFSGSGSGTDFSLNIHPMEEDDSAMYFC | | | | LQSKEVPWT | FGGGTKLEIK (1989) |
| based on IGKV2-30/IGKJ4-1 | | | | | | | |
| LC-344a | | GVPDRFSGSGSGTDFTLKISRVEAEDVGVYYC | | | | LQSKEVPWT | FGGGTKVEIK (1990) |
| LC-344b | | GVPDRFSGSGSGTDFTLKISRVEAEDVGVYYC | | | | LQSKEVPWT | FGGGTKVEIK (1991) |
| LC-344c | | GVPDRFSGSGSGTDFTLKISRVEAEDVGVYYC | | | | LQSKEVPWT | FGGGTKVEIK (1992) |
| LC-344d | | GVPDRFSGSGSGTDFTLKISRVEAEDVGVYYC | | | | LQSKEVPWT | FGGGTKVEIK (1993) |
| LC-344e | | GVPDRFSGSGSGTDFTLKISRVEABDVGVYYC | | | | LQSKEVPWT | FGGGTKVEIK (1994) |
| LC-344f | | GVPDRFSGSGSGTDFTLKISRVEAEDVGVYYC | | | | LQSKEVPWT | FGGGTKVEIK (1995) |
| LC-344g | | GVPDRFSGSGSGTDFTLKISRVEAEDVGVYYC | | | | LQSKEVPWT | FGGGTKVEIK (1996) |
| LC-344h | | GVPDRFSGSGSGTDFTLKISRVEAEDVGVYFC | | | | LQSKEVPWT | FGGGTKVEIK (1997) |
| LC-344i | | GVPDRFSGSGSGTDFTLKISRVEAEDVGVYFC | | | | LQSKEVPWT | FGGGTKVEIK (1998) |
| LC-345a | | GIPVRFSGSGSGTDFTLNIHPVEEEDAATYYC | | | | LQSKEVPWT | FGSGTKLEIK (1999) |
| LC-345b | | GIPVRFSGSGSGTDFTLNIHPVEEEDAATYYC | | | | LQSKEVPWT | FGSGTKLEIK (2000) |

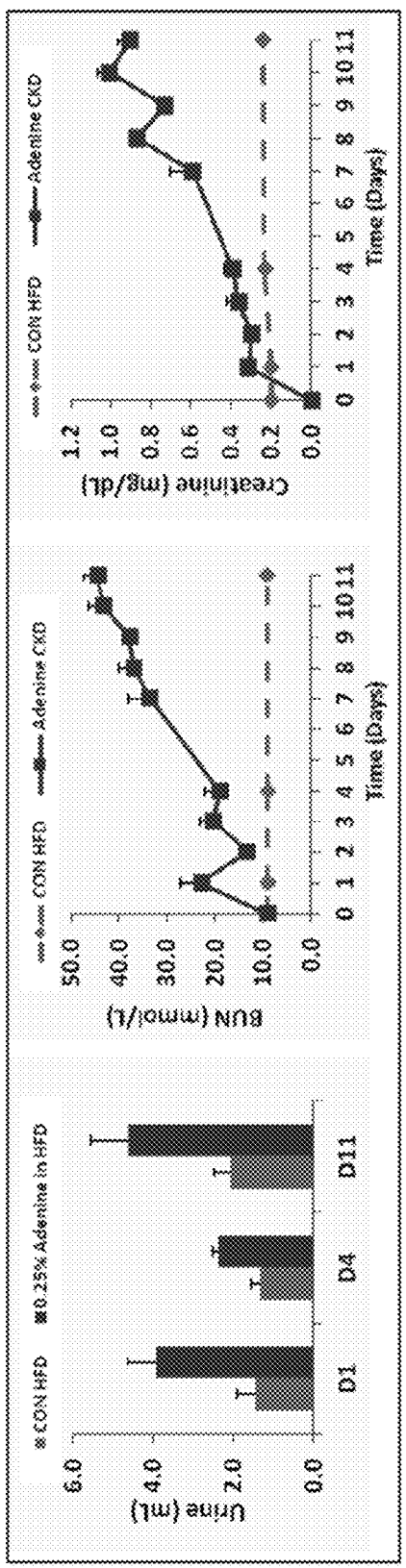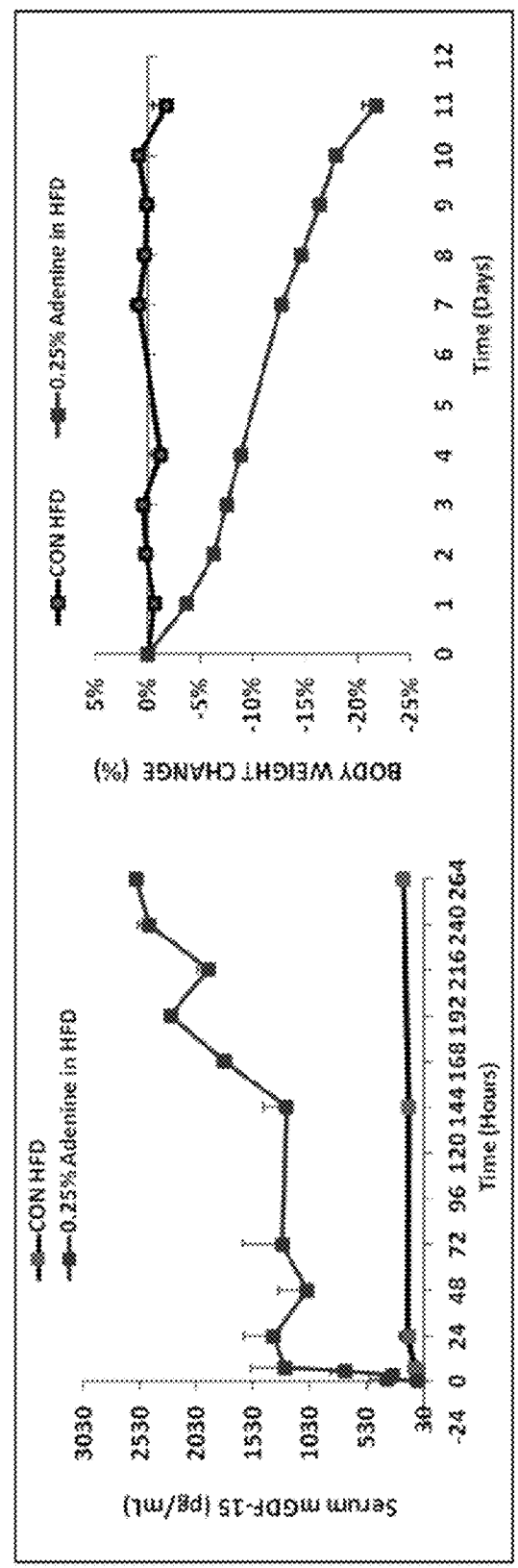
FIG. 26A
FIG. 26B
FIG. 26C

BINDING PROTEINS AND METHODS OF USE THEREOF

This application claims the benefit of U.S. Provisional Application No. 62/316,516, filed Mar. 31, 2016, the entire contents of which is incorporated by reference.

FIELD

The present disclosure relates generally to binding proteins, such as antibodies, that bind to a GDNF Family Receptor Alpha Like (GFRAL) protein, including human GFRAL protein, and methods of their use.

BACKGROUND

Growth differentiation factor 15 (GDF15) is a protein belonging to the transforming growth factor beta (TGF-β) superfamily. GDF15 is also known as TGF-PL, MIC-1, PDF, PLAB, NAG-1, and PTGFB. GDF15 mRNA is reported to be most abundant in the liver, with lower levels seen in some other tissues. Its expression in liver can be significantly up-regulated in injury of organs such as liver, kidney, heart and lung.

GDF15 is reported to play a role in regulating inflammatory and apoptotic pathways in injured tissues and during disease processes. It has been reported that GDF15 is a mediator of cachexia in various diseases. However, cachexia is a complex and incompletely understood syndrome. In addition, at least some tumors over-express and secrete GDF15, and elevated serum GDF15 levels have been associated with various cancers. GDF-15 has been described as a negative regulator of macrophage activation by suppressing the release of TNF-α, IL-1, IL-2 and MCS-F, thus inhibiting the positive feedback of local inflammatory signaling similar to the effects of TGF-β. Monoclonal antibodies against GDF15 have been disclosed as potential therapeutic agents for the treatment of cachexia and of cancer. The receptor for GDF15 is unknown.

There is a significant unmet need for therapeutic agents effective to treat weight loss associated with a number of diseases and conditions, including wasting diseases such as cachexia or sarcopenia and inflammatory conditions such as systemic inflammation or an acute inflammatory response. There is also a significant unmet need for therapeutic agents effective to treat chronic diseases, including cancer, chronic renal disease, chronic obstructive pulmonary disease, AIDS, tuberculosis, chronic inflammatory disease, systemic inflammation, and muscle wasting diseases, including in which involuntary body weight loss and/or muscle mass loss is involved.

SUMMARY

The present disclosure provides proteins that bind to a GDNF Family Receptor Alpha Like (GFRAL) protein, including binding proteins such as antibodies that bind to a GFRAL protein. Such binding proteins including antibodies, may bind to a GFRAL polypeptide, a GFRAL fragment and/or a GFRAL epitope. Such binding proteins, including antibodies, may be antagonists (e.g., inhibit binding of a GDF15 protein to a GFRAL protein, inhibit binding of a RET protein to a GFRAL protein, inhibit a GDF15 protein induced signaling, and/or inhibit formation of a GDF15/GFRAL or a GDF15/GFRAL/RET receptor complex).

The present disclosure also provides binding proteins, including antibodies (e.g., monoclonal antibodies) or fragments thereof, that (i) bind to a GFRAL protein, (ii) inhibit binding of a GDF15 protein to a GFRAL protein, and/or (iii) inhibit binding of a RET protein to a GFRAL protein.

In some embodiments, the anti-GFRAL antibodies are humanized antibodies that bind to a GFRAL polypeptide, a GFRAL fragment, or a GFRAL epitope. In certain embodiments, an anti-GFRAL antibody comprises a VH CDR1, VH CDR2, VH CDR3, VL CDR1, VL CDR2, and/or VL CDR3 of a monoclonal antibody designated 1C1, 3P10, 12A3, 5F12, 5A20, 8D8, 17J16, 25M22, 2B8, 22N5, 2I23, 6N16, 1B3, 19K19, 2B3, 8C10, 2A9, 24G2, 6G9, 2B11, 1A3, P1B6, P1H8, or P8G4 as described herein, or a humanized variant thereof. In certain embodiments, an anti-GFRAL antibody can further comprise a VH FR1, VH FR2, VH FR3, VH FR4, VL FR1, VL FR2, VL FR3, and/or VL FR4 of a human immunoglobulin amino acid sequence or a variant thereof.

In some embodiments, a binding protein (e.g., an anti-GFRAL antibody) comprises six CDRs or less than six CDRs. In some embodiments, a binding protein (e.g., an anti-GFRAL antibody) comprises one, two, three, four, five, or six CDRs selected from VH CDR1, VH CDR2, VH CDR3, VL CDR1, VL CDR2, and/or VL CDR3. In some embodiments, a binding protein (e.g., an anti-GFRAL antibody) comprises one, two, three, four, five, or six CDRs selected from VH CDR1, VH CDR2, VH CDR3, VL CDR1, VL CDR2, and/or VL CDR3 of a monoclonal antibody designated as 1C1, 3P10, 12A3, 5F12, 5A20, 8D8, 17J16, 25M22, 2B8, 22N5, 2I23, 6N16, 1B3, 19K19, 2B3, 8C10, 2A9, 24G2, 6G9, 2B11, 1A3, P1B6, P1H8, or P8G4 as described herein, or a humanized variant thereof. In some embodiments, a binding protein (e.g., an anti-GFRAL antibody) further comprises a scaffold region or framework region, including a VH FR1, VH FR2, VH FR3, VH FR4, VL FR1, VL FR2, VL FR3, and/or VL FR4 of a human immunoglobulin amino acid sequence or a variant thereof.

In some embodiments, the antibody is a humanized antibody, a monoclonal antibody, a recombinant antibody, an antigen binding fragment or any combination thereof. In some embodiments, the antibody is a humanized monoclonal antibody, or antigen binding fragment thereof, that binds to a GFRAL polypeptide (e.g., a cell surface-expressed or soluble GFRAL), a GFRAL fragment, or a GFRAL epitope.

The present disclosure also provides binding proteins such as anti-GFRAL antibodies (i) that competitively block (e.g., in a dose-dependent manner) an anti-GFRAL antibody provided herein from binding to a GFRAL polypeptide (e.g., a cell surface-expressed or soluble GFRAL), a GFRAL fragment, or a GFRAL epitope and/or (ii) that bind to a GFRAL epitope that is bound by an anti-GFRAL antibody provided herein. In other embodiments, the binding proteins such as anti-GFRAL antibody competitively block (e.g., in a dose-dependent manner) monoclonal antibody 25M22, 3P10, 8D8 or 5F12 described herein or a humanized variant thereof from binding to a GFRAL polypeptide (e.g., a cell surface-expressed or soluble GFRAL protein), a GFRAL fragment, or a GFRAL epitope. In other embodiments, the binding proteins such as anti-GFRAL antibody bind to a GFRAL epitope that is bound (e.g., recognized) by monoclonal antibody 25M22, 3P10, 8D8 or 5F12 described herein or a humanized variant thereof.

The present disclosure also provides binding proteins, including antibodies or fragments thereof, that (i) bind to an epitope of a GFRAL protein recognized by an antibody comprising a heavy chain variable region having the amino acid sequence of SEQ ID NO: 3, 7, 11, or 15 and a light chain variable region having the amino acid sequence of SEQ ID NO: 4, 8, 12, or 16, respectively; or (ii) compete for the binding to a GFRAL protein with an antibody comprising a heavy chain variable region having the amino acid sequence of SEQ ID NO: 3, 7, 11, or 15 and a light chain variable region having the amino acid sequence of SEQ ID NO: 4, 8, 12, or 16, respectively. In some embodiments, binding proteins, including antibodies or fragments thereof, are provided herein that bind to a region, including an epitope, of one or more amino acids of a GFRAL protein (e.g., a human GFRAL protein). In some embodiments, binding proteins, including antibodies or fragments thereof, bind to a region of a GFRAL protein (e.g., one or more amino acid residues of an extracellular domain) including, for example, those that bind to: (i) domain 1 of a GFRAL protein (e.g., amino acid residues Q20 to S130 of SEQ ID NO: 1797); (ii) domain 2 of a GFRAL protein (e.g., amino acid residues C131 to C210 of SEQ ID NO: 1797); (iii) domain 3 of a GFRAL protein (e.g., amino acid residues C220 to C316 of SEQ ID NO: 1797); or (iv) an extracellular domain of a GFRAL protein (e.g., amino acid residues Q20 to E351 of SEQ ID NO: 1797).

In some embodiments, binding proteins, including antibodies or fragments thereof, are provided herein that bind to a specific epitope (e.g., one or more amino acid residues) of a GFRAL protein, including, for example, those that bind to: (i) an epitope of a GFRAL protein comprising at least one of (e.g., one or more) amino acid residues SER156, GLN147, LEU148, ALA149, SER150, TYR151, LEU152, LYS153, ALA154, CYS155, PHE174, TYR175, GLU136, ALA137, CYS138, VAL139, GLY140, ASP141, VAL142, VAL143, CYS144, ASN145, ALA146, LEU186, CYS189, CYS191, ALA192, GLN193, SER194, ASP195, ILE196, PRO197, CYS198, GLN199, GLN200, SER201, LYS202, GLU203, ALA204, LEU205, HIS206, SER207, SER130, CYS131, LEU132, GLU133, VAL134, or ALA135 of a GFRAL protein (SEQ ID NO: 1797); (ii) an epitope of a GFRAL protein comprising at least one of (e.g., one or more) amino acid residues LEU132, GLU133, VAL134, ALA135, GLU136, ALA137, CYS138, VAL139, GLY140, ASP141, VAL142, VAL143, CYS144, ASN145, ALA146, GLN147, LEU148, ALA149, SER150, TYR151, PHE174, TYR175, ALA169, ALA170, ILE171, ARG172, PHE173, GLN176, ASN177, ILE178, PRO179, PHE180, ASN181, ILE182, ALA183, GLN184, MET185, LEU186, ALA187, PHE188, or CYS189 of SEQ ID NO: 1797; (iii) an epitope of a GFRAL protein comprising at least one of (e.g., one or more) amino acid residues LEU164, LYS208, VAL212, ASN213, MET214, VAL215, PRO216, PRO217, PRO218, THR219, CYS220, LEU221, VAL223, TRP245, LEU267, CYS269, GLN28, VAL289, GLN290, CYS291, THR292, CYS293, ARG294, THR295, ILE296, THR297, GLN298, SER299, GLU300, GLU301, SER302, LEU303, CYS304, LYS305, ILE306, PHE307, GLN308, HIS309, MET310, LEU311, HIS312, ARG313, LYS314, SER315, CYS316, or PHE317 of SEQ ID NO: 1797; (iv) an epitope of a GFRAL protein comprising at least one of (e.g., one or more) amino acid residues CYS233, ARG234, ARG235, HIS236, TYR237, ARG238, THR239, PHE240, GLN241, SER242, LYS243, CYS244, TRP245, GLN246, ARG247, VAL248, THR249, ARG250, LYS251, CYS252, HIS253, GLU254, ASP255, GLU256, ASN257, CYS258, ILE259, SER260, THR261, LEU262, SER263, LYS264, ASP266, LEU267, THR268, SER272, ASP274, CYS275, ALA278, CYS269, SER270, SER302, LEU303, ILE306, HIS309, LEU311, MET310, SER315, or CYS316 of SEQ ID NO: 1797; (v) an epitope of a GFRAL protein comprising at least one of (e.g., one or more) amino acid residues GLY140, LEU148, ALA149, ALA146, VAL142, ASN145, VAL139, ALA135, GLU136, LEU152, LEU132, SER201, ALA204, LEU205, LYS153, ILE196, PRO197, or GLN200 of SEQ ID NO: 1797; (vi) an epitope of a GFRAL protein comprising at least one of (e.g., one or more) amino acid residues GLU136, ALA137, VAL139, GLY140, ASP141, VAL142, VAL143, CYS144, ASN145, ALA146, GLN147, PHE173, ASN177, ILE178, PRO179, ASN181, ILE182, or MET185 of SEQ ID NO: 1797; (vii) an epitope of a GFRAL protein comprising at least one of (e.g., one or more) amino acid residues GLN298 or GLU301 of SEQ ID NO: 1797; or (viii) an epitope of a GFRAL protein comprising at least one of (e.g., one or more) amino acid residues ARG234, ARG238, GLN241, SER242, LYS243, TRP245, GLN246, THR249, ARG250, LYS251, CYS252, HIS253, ASP255, ASN257, CYS258, SER260, THR261, or LEU262 of SEQ ID NO: 1797. Such antibodies provided above can, in some embodiments, inhibit GDF15-induced signaling and/or signaling or activation of a GFRAL/GDF15 or RET/GFRAL/GDF15 receptor complex, for example, in a cell that expresses a GFRAL protein. Additionally, in some embodiments, the antibody is a monoclonal antibody, for example, a humanized, human or chimeric antibody.

In some embodiments, the binding proteins such as anti-GFRAL antibodies provided herein are conjugated or recombinantly linked to a diagnostic agent, a detectable agent (e.g., a radioisotope, an enzyme, a fluorescent compound, a bioluminescent compound or a chemiluminescent compound). In some embodiments, the binding proteins such as anti-GFRAL antibodies provided herein are used (e.g., administered) with a therapeutic agent. In some aspects, the therapeutic agent is a drug, including one or more drugs such as an inhibitor of Activin-A, an inhibitor of ActRIIB, an inhibitor of IL-6 or an inhibitor of IL-6R, a ghrelin, a ghrelin mimetic or a GHS-RIa agonist, a SARM, a TNFα inhibitor, an IL-Ia inhibitor, a myostatin inhibitor, a beta-blocker, a melanocortin peptide inhibitor, a melanocortin receptor inhibitor, or an anti-cancer agent.

In certain embodiments, compositions are provided comprising a binding protein such as an anti-GFRAL antibody described herein. Also provided herein are pharmaceutical compositions comprising a binding protein such as an GFRAL antibody as described herein.

The present disclosure also provides isolated nucleic acid molecules encoding an immunoglobulin heavy chain, an immunoglobulin light chain, VH region, VL region, VH CDR1, VH CDR2, VH CDR3, VL CDR1, VL CDR2, and/or VL CDR3 of binding proteins (e.g., anti-GFRAL antibodies) that bind to a GFRAL polypeptide, a GFRAL polypeptide fragment, or a GFRAL epitope (e.g., one or more amino acids of a GFRAL protein, including of an extracellular domain of a GFRAL protein). In some embodiments, the nucleic acid molecule encodes a VH region, VL region, VH CDR1, VH CDR2, VH CDR3, VL CDR1, VL CDR2, and/or VL CDR3 of a monoclonal antibody designated as 1C1, 3P10, 12A3, 5F12, 5A20, 8D8, 17J16, 25M22, 2B8, 22N5, 2I23, 6N16, 1B3, 19K19, 2B3, 8C10, 2A9, 24G2, 6G9, 2B11, 1A3, P1B6, P1H8, or P8G4 as described herein, or a humanized variant thereof. In some embodiments, the nucleic acid molecule further encodes a scaffold region or a framework region, including VH FR1, VH FR2, VH FR3, VH FR4, VL FR1, VL FR2, VL FR3, and/or VL FR4 of a human immunoglobulin amino acid sequence or a variant thereof. Also provided herein are vectors and host cells comprising the nucleic acid molecules encoding a binding protein such as anti-GFRAL antibody, as well as methods of producing a binding protein such as an anti-GFRAL antibody by culturing the host cells provided herein under conditions that promote the production of a binding protein such as an anti-GFRAL antibody.

The present disclosure also provides methods of treating, preventing or alleviating a GFRAL-mediated disease, disorder, or condition, including a GDF15-mediated disease, disorder or condition, (e.g., one or more symptoms) comprising administering to a subject a therapeutically effective amount of a binding protein such as an anti-GFRAL antibody provided herein, including a subject in need thereof, thereby treating, preventing or alleviating the disease, disorder or condition. In some embodiments, the disease, disorder or condition is caused by or otherwise associated with a GDF15 protein (e.g., a human GDF15 protein) and/or a GFRAL protein (e.g., a human GFRAL protein), such as those related to GDF15-induced signaling in a subject. In certain embodiments, the disease, disorder, or condition is treatable by reducing the occurrence, frequency or severity of cachexia, sarcopenia, or muscle wasting, bone wasting or involuntary loss of body weight. In certain embodiments, the disease, disorder, or condition is cachexia. In certain embodiments, the disease, disorder, or condition is a cancer. In certain embodiments, the disease, disorder, or condition is a cardiovascular disease. In certain embodiments, the disease, disorder, or condition is a chronic inflammatory disease (e.g., chronic renal disease, chronic obstructive pulmonary disease). In certain embodiments, the disease, disorder, or condition is a cancer that has decreased sensitivity to (e.g., resistance to) a chemotherapeutic agent (e.g., an anti-tumor antibody such as trastuzumab) that is induced by or related to a GDF15 protein, including elevated levels of GDF15.

In some embodiments, the disease, disorder or condition is or is related to cachexia, sarcopenia, muscle wasting or loss of muscle mass, bone wasting, involuntary loss of body weight (e.g., body weight loss associated with or due to a disease, disorder, or condition). In some embodiments, the disease, disorder or condition is selected from the group of underlying diseases associated with cachexia including, but are not limited to, cancer, chronic renal disease, chronic obstructive pulmonary disease, AIDS, tuberculosis, chronic inflammatory diseases, sepsis and other forms of systemic inflammation, muscle wasting, such as muscular dystrophy, and the eating disorder known as anorexia nervosa.

In some embodiments, the methods of treating, preventing or ameliorating include methods of improving body weight gain or reducing body weight loss, or improving muscle mass gain or reducing muscle mass loss. In some embodiments, the methods of treating, preventing or ameliorating result in improved methods of treating cancer, by preventing, minimizing or reducing the occurrence, frequency or severity of cachexia, sarcopenia or muscle wasting, bone wasting or involuntary loss of body weight.

The present disclosure also provides methods for detecting GFRAL in a sample comprising contacting the sample with a binding protein such as an anti-GFRAL antibody as described herein, that comprises a detectable agent. In certain embodiments, the sample comprises a cell expressing GFRAL on its surface.

The present disclosure also provides kits comprising a binding protein such as an anti-GFRAL antibody that binds to a GFRAL polypeptide, a GFRAL fragment or a GFRAL epitope as described herein.

BRIEF DESCRIPTION OF THE FIGURES

FIG. 1 shows a sequence alignment between various GFRAL proteins. SEQ ID NOS are noted in parenthesis and bold text.

FIG. 2 shows a sequence alignment between various GDF15 proteins. SEQ ID NOS are noted in parenthesis and bold text.

FIG. 4A-4B show alignments of VH and VL sequences for exemplary anti-GFRAL antibodies. SEQ ID NOS are noted in parenthesis and bold text.

FIG. 5A-5F show alignments of VH and VL sequences for exemplary anti-GFRAL antibodies that bind to domain 1 (FIGS. 5A-5B), domain 2 (FIGS. 5C-5D), or domain 3 (FIGS. 5E-5F) of GFRAL. SEQ ID NOS are noted in parenthesis and bold text.

FIGS. 6A-6B show alignments of VH and VL sequences of humanized 1C1 antibodies. SEQ ID NOS are noted in parenthesis and bold text.

FIGS. 7A-7B show alignments of VH and VL sequences of humanized 25M22 antibodies. SEQ ID NOS are noted in parenthesis and bold text.

FIGS. 8A-8B show alignments of VH and VL sequences of humanized 17J16 antibodies. SEQ ID NOS are noted in parenthesis and bold text.

FIGS. 9A-9B show alignments of VH and VL sequences of humanized 5F12 antibodies. SEQ ID NOS are noted in parenthesis and bold text.

FIGS. 10A-10B show alignments of VH and VL sequences of humanized 3P10 antibodies. SEQ ID NOS are noted in parenthesis and bold text.

FIGS. 26A-26C depict results of an experiment showing the effects of dietary adenine.

FIG. 49 shows amino acid sequences for a GFRAL protein (residues S130 to N318 of SEQ ID NO: 1797) and 25M22 Fab heavy chain (HC) residues Q1 to P138 and G146 to P225 of SEQ ID NO:1826 and light chain (LC) residues D1 to E218 of SEQ ID NO:1827. Residues having grey background and white text indicate core interaction interface amino acids for both the GFRAL protein and the 25M22 Fab. Residues on the Fab HC or LC having grey background with black or white lettering indicate exemplary CDR sequences for the 25M22 Fab.

FIG. 54 shows amino acid sequences for a GFRAL protein (residues S130 to N318 of SEQ ID NO: 1797) and 3P10 Fab heavy chain (HC) residues Q1 to A130 and G138 to C221 of SEQ ID NO:1824 and light chain (LC) residues D1 to C218 of SEQ ID NO:1825. Residues having grey background and white text indicate core interaction interface amino acids for both the GFRAL protein and the 3P10 Fab. Residues on the Fab HC or LC having grey background with black or white lettering indicate exemplary CDR sequences for the 3P10 Fab.

FIG. 56A shows core interaction interface residues and FIG. 56B shows boundary interaction interface residues.

FIG. 61 shows amino acid sequences for a GFRAL protein (residues S130 to N318 of SEQ ID NO: 1797) and 8D8 Fab heavy chain (HC) residues Q1 to K217 of SEQ ID NO:1828 and light chain (LC) residues D1 to R211 of SEQ ID NO:1829. Residues having grey background and white text indicate core interaction interface amino acids for both the GFRAL protein and the 8D8 Fab. Residues on the Fab HC or LC having grey background with black or white lettering indicate exemplary CDR sequences for the 8D8 Fab.

FIG. 64 shows amino acid sequences for a GFRAL (residues S130 to N318 of SEQ ID NO: 1797) and 5F12 Fab heavy chain (HC) residues Q1 to K223 of SEQ ID NO:1830 and light chain (LC) residues N1 to E217 of SEQ ID NO:1831. Residues having grey background and white text indicate core interaction interface amino acids for both the GFRAL protein and the 5F12 Fab. Residues on the Fab HC or LC having grey background with black or white lettering indicate exemplary CDR sequences for the 5F12 Fab.

DETAILED DESCRIPTION

Figure 3:
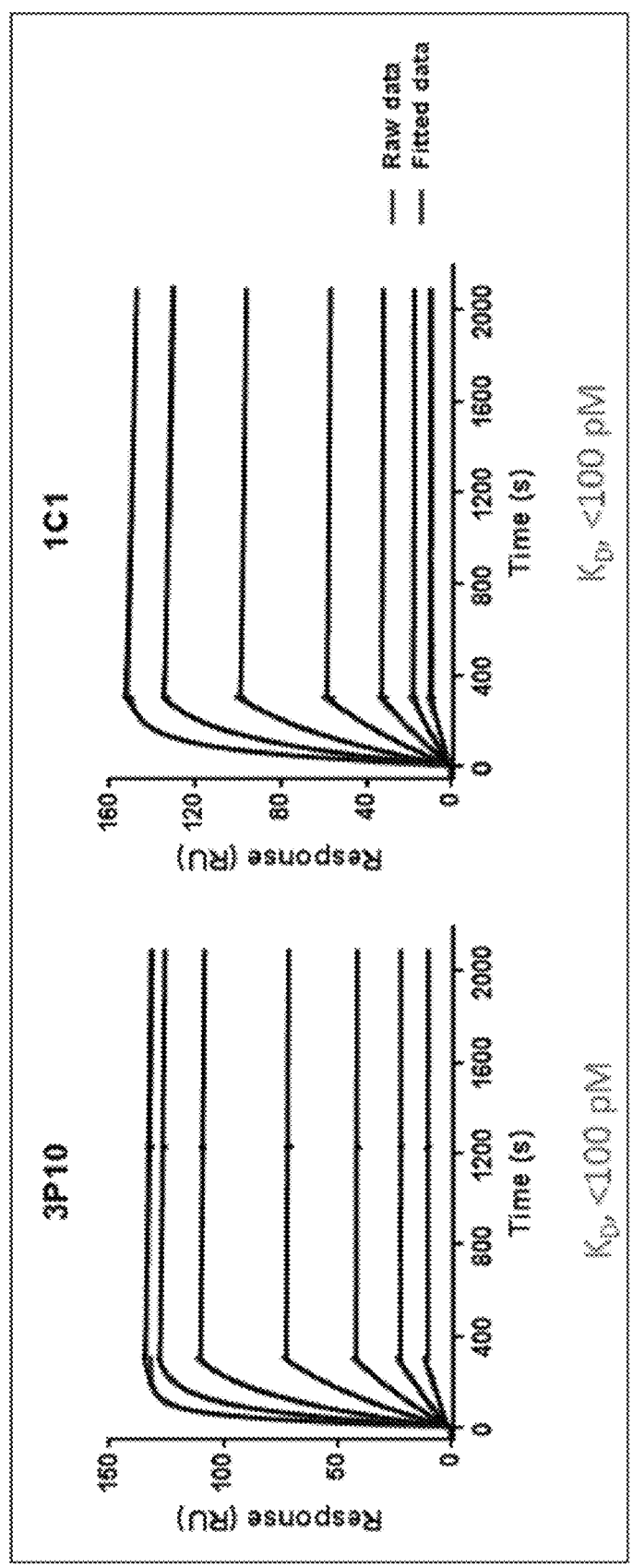
FIG. 3 depicts results of an experiment showing binding affinity of exemplary anti-GFRAL antibodies 1C1 and 3P10 for a GFRAL protein.

Binding proteins, such as antibodies that bind a GFRAL protein, including a human GFRAL protein, are provided herein. A unique property of such binding proteins, including antibodies disclosed herein, is their antagonistic nature, including the ability to inhibit an effect of a GDF15 protein and/or to inhibit binding of a GDF15 protein to a GFRAL protein or inhibit binding of a RET protein to a GFRAL protein, including wherein the inhibition of binding reduces (e.g., blocks) GDF15 signaling. Remarkably and specifically, binding proteins such as antibodies to a GFRAL protein disclosed herein (i) bind to a GFRAL protein, (ii) inhibit binding of a GDF15 protein to a GFRAL protein, and/or (iii) inhibit binding of a RET protein to a GFRAL protein, including blocking the formation of a GDF15/GFRAL protein complex or a GDF15/GFRAL/RET protein complex or GDF15 signaling, including, for example, as measured by several in vitro cell-based assays. Such assays may include (1) a ELK1-luciferase reporter assay (see, e.g., Example 3); and/or (2) ERK-phosphorylation assay in U2OS cells (see, e.g., Example 4). Binding proteins such as anti-GFRAL antibodies, as described herein, therefore are expected to inhibit GDF15 activities in vivo (e.g., related to the signaling function of GDF15). This property makes the disclosed binding proteins, including anti-GFRAL antibodies, viable therapeutics for the treatment of a disease, disorder or condition that is caused by or otherwise associated with a GDF15 protein (e.g., a human GDF15 protein) and/or a GFRAL protein (e.g., a human GFRAL protein), such as those related to GDF15-induced signaling in a subject.

The binding proteins, such as antibodies that bind a GFRAL protein, that are provided herein share the common feature of antagonizing the binding of (i) a GDF15 protein to a GFRAL protein and/or (ii) a RET protein to a GFRAL protein. The anti-GFRAL antibodies provided herein include humanized anti-GFRAL antibodies, including humanized anti-GFRAL antibodies derived from or based on 1C1, 3P10, 12A3, 5F12, 5A20, 8D8, 17J16, 25M22, 2B8, 22N5, 2I23, 6N16, 1B3, 19K19, 2B3, 8C10, 2A9, 24G2, 6G9, 2B11, 1A3, P1B6, P1H8, and/or P8G4 having CDR sequences as described in Tables 1-24 or FIGS. 4-10. Such anti-GFRAL antibodies, including humanized anti-GFRAL antibodies, bind to a specific domain of a GFRAL protein including, for example, those that bind to: (i) domain 1 of a GFRAL protein (e.g., amino acid residues Q20 to S130 of SEQ ID NO: 1797); (ii) domain 2 of a GFRAL protein (e.g., amino acid residues C131 to C210 of SEQ ID NO: 1797); (iii) domain 3 of a GFRAL protein (e.g., amino acid residues C220 to C316 of SEQ ID NO: 1797); or (iv) an extracellular domain of a GFRAL protein (e.g., amino acid residues Q20 to E351 of SEQ ID NO: 1797).

In some embodiments of the present disclosure, the binding proteins such as anti-GFRAL antibodies may comprise immunoglobulin variable regions which comprise one or more complementary determining regions (CDRs) as described in Tables 1-24. In such binding proteins (e.g., anti-GFRAL antibodies), the CDRs may be joined with one or more scaffold regions or framework regions, which orient(s) the CDR(s) such that the proper antigen binding properties of the CDR(s) is achieved. Such binding proteins, including anti-GFRAL antibodies as described herein, can inhibit (e.g., block) the interaction (i) between a GDF15 protein and a GFRAL protein and/or (ii) between a RET protein and a GFRAL protein. Such binding proteins, including anti-GFRAL antibodies as described herein, can inhibit (e.g., block) GDF15 signaling.

In some embodiments of the present disclosure, the binding proteins such as anti-GFRAL antibodies bind to: (i) an epitope of a GFRAL protein comprising at least one of (e.g., one or more) amino acid residues SER156, GLN147, LEU148, ALA149, SER150, TYR151, LEU152, LYS153, ALA154, CYS155, PHE174, TYR175, GLU136, ALA137, CYS138, VAL139, GLY140, ASP141, VAL142, VAL143, CYS144, ASN145, ALA146, LEU186, CYS189, CYS191, ALA192, GLN193, SER194, ASP195, ILE196, PRO197, CYS198, GLN199, GLN200, SER201, LYS202, GLU203, ALA204, LEU205, HIS206, SER207, SER130, CYS131, LEU132, GLU133, VAL134, or ALA135 of a GFRAL protein (SEQ ID NO: 1797); (ii) an epitope of a GFRAL protein comprising at least one of (e.g., one or more) amino acid residues LEU132, GLU133, VAL134, ALA135, GLU136, ALA137, CYS138, VAL139, GLY140, ASP141, VAL142, VAL143, CYS144, ASN145, ALA146, GLN147, LEU148, ALA149, SER150, TYR151, PHE174, TYR175, ALA169, ALA170, ILE171, ARG172, PHE173, GLN176, ASN177, ILE178, PRO179, PHE180, ASN181, ILE182, ALA183, GLN184, MET185, LEU186, ALA187, PHE188, or CYS189 of SEQ ID NO: 1797; (iii) an epitope of a GFRAL protein comprising at least one of (e.g., one or more) amino acid residues LEU164, LYS208, VAL212, ASN213, MET214, VAL215, PRO216, PRO217, PRO218, THR219, CYS220, LEU221, VAL223, TRP245, LEU267, CYS269, GLN28, VAL289, GLN290, CYS291, THR292, CYS293, ARG294, THR295, ILE296, THR297, GLN298, SER299, GLU300, GLU301, SER302, LEU303, CYS304, LYS305, ILE306, PHE307, GLN308, HIS309, MET310, LEU311, HIS312, ARG313, LYS314, SER315, CYS316, or PHE317 of SEQ ID NO: 1797; (iv) an epitope of a GFRAL protein comprising at least one of (e.g., one or more) amino acid residues CYS233, ARG234, ARG235, HIS236, TYR237, ARG238, THR239, PHE240, GLN241, SER242, LYS243, CYS244, TRP245, GLN246, ARG247, VAL248, THR249, ARG250, LYS251, CYS252, HIS253, GLU254, ASP255, GLU256, ASN257, CYS258, ILE259, SER260, THR261, LEU262, SER263, LYS264, ASP266, LEU267, THR268, SER272, ASP274, CYS275, ALA278, CYS269, SER270, SER302, LEU303, ILE306, HIS309, LEU311, MET310, SER315, or CYS316 of SEQ ID NO: 1797; (v) an epitope of a GFRAL protein comprising at least one of (e.g., one or more) amino acid residues GLY140, LEU148, ALA149, ALA146, VAL142, ASN145, VAL139, ALA135, GLU136, LEU152, LEU132, SER201, ALA204, LEU205, LYS153, ILE196, PRO197, or GLN200 of SEQ ID NO: 1797; (vi) an epitope of a GFRAL protein comprising at least one of (e.g., one or more) amino acid residues GLU136, ALA137, VAL139, GLY140, ASP141, VAL142, VAL143, CYS144, ASN145, ALA146, GLN147, PHE173, ASN177, ILE178, PRO179, ASN181, ILE182, or MET185 of SEQ ID NO: 1797; (vii) an epitope of a GFRAL protein comprising at least one of (e.g., one or more) amino acid residues GLN298 or GLU301 of SEQ ID NO: 1797; or (viii) an epitope of a GFRAL protein comprising at least one of (e.g., one or more) amino acid residues ARG234, ARG238, GLN241, SER242, LYS243, TRP245, GLN246, THR249, ARG250, LYS251, CYS252, HIS253, ASP255, ASN257, CYS258, SER260, THR261, or LEU262 of SEQ ID NO: 1797. Such antibodies provided above can, in some embodiments, inhibit GDF15-induced signaling and/or signaling or activation of a GFRAL/GDF15 or RET/GFRAL/GDF15 receptor complex, for example, in a cell that expresses a GFRAL protein. Additionally, in some embodiments of the present disclosure, the antibody is a monoclonal antibody, for example, a humanized antibody.

General Techniques

Techniques and procedures described or referenced herein include those that are generally well understood and/or commonly employed using conventional methodology by those skilled in the art, such as, for example, the widely utilized methodologies described in Sambrook et al., Molecular Cloning: A Laboratory Manual 3rd. edition (2001) Cold Spring Harbor Laboratory Press, Cold Spring Harbor, N.Y.; Current Protocols in Molecular Biology (F. M. Ausubel, et al. eds., (2003)); Therapeutic Monoclonal Antibodies: From Bench to Clinic, Z. An, ed, Wiley, Hoboken N.J. (2009); Monoclonal Antibodies: Methods and Protocols, M. Albitar, ed., Humana Press, Totawa, N.J. (2010); and Antibody Engineering, 2nd Ed., Vols 1 and 2, Kontermann and Dubel, eds., Springer-Verlag, Heidelberg, 2010.

Terminology

Unless described otherwise, all technical and scientific terms used herein have the same meaning as is commonly understood by one of ordinary skill in the art. For purposes of interpreting this specification, the following description of terms will apply and whenever appropriate, terms used in the singular will also include the plural and vice versa. All patents, applications, published applications and other publications are incorporated by reference in their entirety. In the event that any description of terms set forth conflicts with any document incorporated herein by reference, the description of term set forth below shall control.

The term "GDNF Family Receptor Alpha Like" "growth differentiation factor 15 receptor," "GFRAL" or "GFRAL protein" and similar terms refers to a polypeptide ("polypeptide," and "protein" are used interchangeably herein) or any native GFRAL from any vertebrate source, including mammals such as primates (e.g., humans, cynomolgus monkey (cyno)), dogs, and rodents (e.g., mice and rats), unless otherwise indicated, and, in certain embodiments, includes related GFRAL polypeptides, including SNP variants thereof. GFRAL is also known in the art as "C6orf144," "Chromosome 6 Open reading Frame 144," BA360D14.1" "IVFI9356," and "UNQ9356."

The amino acid sequence of a full-length precursor human GFRAL is provided below, which includes a signal peptide sequence (underlined and lowercase residues):

(SEQ ID NO: 1797)
mivfiflamqlsleneytsQTNNCTYLREQCLRDANGCKHAWRVMEDACN

DSDPGDPCKMRNSSYCNLSIQYLVESNFQFKECLCTDDFYCTVNKLLGKK

CINKSDNVKEDKFKWNLTTRSHHGFKGMWSCLEVAEACVGDVVCNAQLAS

YLKACSANGNPCDLKQCQAAIRFFYQNIPFNIAQMLAFCDCAQSDIPCQQ

SKEALHSKTCAVNMVPPPTCLSVIRSCQNDELCRRHYRTFQSKCWQRVTR

KCHEDENCISTLSKQDLTCSGSDDCKAAYIDILGTVLQVQCTCRTITQSE

ESLCKIFQHMLHRKSCFNYPTLSNVKGMALYTRKHANKITLTGFHSPFNG

EVIYAAMCMTVTCGILLLVMVKLRTSRISSKARDPSSIQIPGEL.

The amino acid sequence of a mature human GFRAL polypeptide is provided below:

(SEQ ID NO: 1798)
QTNNCTYLREQCLRDANGCKHAWRVMEDACNDSDPGDPCKMRNSSYCNLS

IQYLVESNFQFKECLCTDDFYCTVNKLLGKKCINKSDNVKEDKFKWNLTT

RSHHGFKGMWSCLEVAEACVGDVVCNAQLASYLKACSANGNPCDLKQCQA

AIRFFYQNIPFNIAQMLAFCDCAQSDIPCQQSKEALHSKTCAVNMVPPPT

CLSVIRSCQNDELCRRHYRTFQSKCWQRVTRKCHEDENCISTLSKQDLTC

SGSDDCKAAYIDILGTVLQVQCTCRTITQSEESLCKIFQHMLHRKSCFNY

PTLSNVKGMALYTRKHANKITLTGFHSPFNGEVIYAAMCMTVTCGILLLV

MVKLRTSRISSKARDPSSIQIPGEL.

In some embodiments, GFRAL refers to a protein that is at least 55% identical to the amino acid sequence of mature human GFRAL (SEQ ID NO: 1798). Binding proteins, such as anti-GFRAL antibodies as disclosed herein, can bind GFRAL and/or modulate signaling, as described herein. In certain embodiments, antibodies described herein bind to human GFRAL.

Human GFRAL has an extracellular domain (e.g., residues 20-351 of SEQ ID NO: 1797), a transmembrane domain (e.g., residues 352-371 of SEQ ID NO: 1797) and a cytoplasmic domain (e.g., residues 372-394 of SEQ ID NO: 1797).

A nucleic acid sequence encoding a precursor GFRAL polypeptide is provided below:

(SEQ ID NO: 1799)
TTATTCTGGACAGTTACTCTTAAGAAAGTTGTCAGAAGAAACGCATCTGC

CTTTTTTTCCAGGTGAACTGCCGTGAGTTGTCCAGCATGATAGTGTTTAT

TTTCTTGGCTATGGGGTTAAGCTTGGAAAATGAATACACTTCCCAAACCA

-continued

```
ATAATTGCACATATTTAAGAGAGCAATGCTTACGTGATGCAAATGGATGT

AAACATGCTTGGAGAGTAATGGAAGATGCCTGCAATGATTCAGATCCAGG

TGACCCCTGCAAGATGAGGAATTCATCATACTGTAACCTGAGTATCCAGT

ACTTAGTGGAAAGCAATTTCCAATTTAAAGAGTGTCTTTGCACTGATGAC

TTCTATTGTACTGTGAACAAACTGCTTGGAAAAAAATGTATCAATAAATC

AGATAACGTGAAAGAGGATAAATTCAAATGGAATCTAACTACACGTTCCC

ATCATGGATTCAAAGGGATGTGGTCCTGTTTGGAAGTGGCAGAGGCATGT

GTAGGGGATGTGGTCTGTAATGCACAGTTGGCCTCTTACCTTAAAGCTTG

CTCAGCAAATGGAAATCCGTGTGATCTGAAACAGTGCCAAGCAGCCATAC

GGTTCTTCTATCAAAATATACCTTTTAACATTGCCCAGATGTTGGCTTTT

TGTGACTGTGCTCAATCTGATATACCTTGTCAGCAGTCCAAAGAAGCTCT

TCACAGCAAGACATGTGCAGTGAACATGGTTCCACCCCCTACTTGCCTCA

GTGTAATTCGCAGCTGCCAAAATGATGAATTATGCAGGAGGCACTATAGA

ACATTTCAGTCAAAATGCTGGCAGCGTGTGACTAGAAAGTGCCATGAAGA

TGAGAATTGCATTAGCACCTTAAGCAAACAGGACCTCACTTGTTCAGGAA

GTGATGACTGCAAAGCTGCTTACATAGATATCCTTGGGACGGTCCTTCAA

GTGCAATGTACCTGTAGGACCATTACACAAAGTGAGGAATCTTTGTGTAA

GATTTTCCAGCACATGCTTCATAGAAAATCATGTTTCAATTATCCAACCC

TGTCTAATGTCAAAGGCATGGCATTGTATACAAGAAAACATGCAAACAAA

ATCACTTTAACTGGATTTCATTCCCCCTTCAATGGAGAAGTAATCTATGC

TGCCATGTGCATGACAGTCACCTGTGGAATCCTTCTGTTGGTTATGGTCA

AGCTTAGAACTTCCAGAATATCAAGTAAAGCAAGAGATCCTTCATCGATC

CAAATACCTGGAGAACTCTGATTCATTAGGAGTCATGGACCTATAACAAT

CACTCTTTTCTCTGCTTTTCTTCTTTCCTCTTTTCTTCTCTCCTCTCCTC

TCCTCTCTTCTCCTCTCCTCCCCTCCCCTCTCTGTTTCTTTTTCTTTTTC

TTTTCTTTTTTGTGGCGGAGTTTTGCTCTTGTTGCCCAGGCTGCAGTACA

ATGGCTCAATCTCGGTTCACTGCAACCTCTGCCTCCAAGGTTCAAGTGAT

TTTCCTGCCTCAGCCTTCCCGAGTAGCTGGGATTACAGGTACCCGCCACC

ACGCCCAGCTAATTTTTTTGTATTTTTAGTAGAGATGGGGTTTTGCCAAA

TTGGCCAGGGTGGTCTCAAACTCCTGACCTCAGGTGATCCACCCACCTCG

GCCTCCCAAAGTGCTGGGATTACAGGCGTGAGCAACCACGTCAAGACAAC

AATCACTTTCTTTAAAGCAAATCCTACAGCTGGTCAACACCCTATTCCAT

CTGTCATCGAGAAAGAAAATGTTAAAATAGACTTAAAAATATTGCTTTGT

TACATATAATAATATGGCATGATGATGTTATTTTTTCTTAATACTCAAG

AAAAAATATATGGTGGTATCTTTTACAACACTGGAACAGAAATAAAGTTT

CCCTTGAAGGC.
```

"GFRAL" as used herein encompasses human GFRAL and variants thereof, including but not limited to orthologs thereof, such as murine GFRAL, rat GFRAL, cyno GFRAL, and the like. GFRAL is not TGFβ RII (NCBI Ref. Seqs.: NM_001024847.2 (GI:133908632); NM_003242.5 (GI: 133908633)) or orthologs thereof. GFRAL is distinct from TGFβ RI (NCBI Ref. Seqs.: NP_001124388.1 (GI: 195963412); NP_004603.1 (GI:4759226)) or orthologs thereof. In certain embodiments, GFRAL may be a protein having the amino acid sequence that is at least 55%, 60%, 65%, 70%, 75%, 80%, 85%, 90%, 95%, 96%, 97%, 98%, 99% or more identical to SEQ ID NO: 1797. Such exemplary GFRAL proteins include chimpanzee (99%), cynomolgus monkey (92%), giant panda (82%), dog (81%), cat (80%), pig (77%), bovine (75%), mouse (70%), rat (70%), Chinese hamster (65%), and platypus (59%), as shown in FIG. 1.

An amino acid sequence of a GFRAL protein from cynomolgus monkey (cyno), scientific name *Macaca fascicularis*, is provided below, which includes a signal peptide sequence (underlined residues):

(SEQ ID NO: 1800)
mivliflalglsleneytsQTNNCTYLREQCLHDANGCKHAWRIMEDACN

DSDPGDPCKMNNSSYCNLSIQYLVESNFRFKECLCTDDFYCTVNKLLGKE

CVNKSDNMREDKFKWNLTTHSHHGFKGMWSCLEVAEACVGDVVCNAQLAS

YLKACSANGNPCDVKHCQAAIRFFYQNIPFNIAQMLAFCDCSQSDIPCQQ

SKEALHSKPCALNMVPPPTCLNVIRSCQNDELCRRHYRTFQSKCWQRVTR

KCHEDENCISALSKQDLTCSGSDDCKAAYIDILGTVLQVQCNCRTITQSE

ESLCKIFQHMLHRKSCFNYPTLSNVKSMALYTRKHTNKITLTGFQSPFNG

EVIYAAMCMTVTCGILLLVMVKLRTSRISSKARDPSLSQVPGEL.

An encoding nucleic acid sequence of a cyno GFRAL protein is provided below:

(SEQ ID NO: 1801)
```
ACCCACCAGAAAGAAGGAGCTCCAGACACATCTGAACGTCTGAAGGAAGA

AACTCCCGACACACCATCTTTAAGAAATGTAACTCTCACTGCGAGGGTAT

GTGGCTTCATTCTTGAAGTCAGGGAGACCAAGAACCCACCAATTGCAGGC

ACACAAGGGGTCCTTATTTTATTCAGGTGAACAGCTGTGAGTTGTCCAGC

ATGATAGTGCTTATTTTCTTGGCTTTGGGGCTAAGCTTGGAAAATGAATA

CACTTCCCAAACCAATAATTGCACATATTTAAGAGAGCAATGCCTACATG

ATGCAAATGGATGTAAACATGCTTGGAGAATAATGGAAGATGCCTGCAAT

GATTCAGATCCAGGTGACCCCTGCAAGATGAATAATTCATCATACTGTAA

CCTGAGTATCCAGTACTTAGTGGAAAGCAATTTCCGATTTAAAGAGTGTC

TTTGCACTGATGACTTCTATTGTACTGTGAACAAACTGCTTGGAAAAGAA

TGTGTCAATAAATCAGATAACATGAGAGAGGATAAATTCAAATGGAATCT

AACTACACATTCCCATCATGGATTCAAAGGGATGTGGTCCTGTTTGGAAG

TGGCAGAGGCATGTGTAGGGGATGTGGTCTGTAATGCACAGTTGGCCTCT

TACCTTAAAGCTTGCTCAGCAAATGGAAATCCGTGTGATGTGAAACACTG

CCAAGCAGCCATACGGTTCTTCTATCAAAATATACCTTTTAACATTGCCC

AGATGTTGGCTTTTTGTGACTGTTCTCAATCTGATATACCTTGTCAGCAG

TCCAAAGAAGCTCTTCACAGCAAGCCATGTGCACTGAACATGGTTCCACC

CCCTACTTGCCTCAATGTAATTCGCAGCTGCCAAAATGATGAATTATGCA

GGAGGCACTATAGAACATTTCAGTCAAAATGCTGGCAGCGTGTGACTAGA

AAGTGCCATGAAGATGAGAATTGCATTAGCGCCTTAAGCAAACAGGACCT

CACATGTTCAGGAAGTGATGACTGCAAAGCTGCTTACATAGATATCCTTG
```

```
GGACAGTCCTTCAAGTGCAATGTAACTGTAGGACCATTACACAAAGTGAG

GAATCTTTGTGCAAGATTTTCCAGCACATGCTTCATAGAAAATCATGTTT

CAATTATCCAACCCTGTCTAATGTCAAAAGCATGGCATTGTATACAAGAA

AACATACAAACAAAATCACTTTAACTGGATTTCAGTCCCCCTTCAATGGA

GAAGTAATCTATGCTGCCATGTGCATGACAGTCACCTGTGGAATCCTTCT

CTTGGTTATGGTCAAGCTTAGAACTTCCAGAATATCAAGTAAAGCAAGAG

ATCCTTCACTGAGCCAAGTACCTGGAGAACTCTGATTCATTAGGAGTCAT

GGACCCATAACAATCACTCCCCTTCCCTTCCCTTCCCTTCCCTTCCCTTC

CCTTCCCTTCCCTTCCCTTCCCTTCC.
```

An amino acid sequence of a GFRAL protein from mouse, scientific name *Mus musculus*, is provided below, which includes a signal peptide sequence (underlined residues):

```
                                      (SEQ ID NO: 1802)
mlvfiflavtlssenesssQTNDCAHLIQKCLIDANGCEQSWRSMEDTCL

TPGDSCKINNSLHCNLSIQALVEKNFQFKECLCMDDLHCTVNKLFGKKCT

NKTDNMEKDNKDKWNLTTTPFYHGFKQMQSCLEVTEACVGDVVCNAQLAL

YLKACSANGNLCDVKHCQAAIRFFYQNMPFNTAQMLAFCDCAQSDIPCQQ

SKETLHSKPCALNIVPPPTCLSVIHTCRNDELCRTHYRTFQTECWPHITG

KCHEDETCISMLGKQDLTCSGSESCRAAFLGTFGTVLQVPCACRGVTQAE

EHVCMIFQHMLHSKSCFNYPTPNVKDISSYEKKNSKEITLTGFNSFFNGE

LLYVVVCMAVTCGILFLVMLKLRIQSEKRDPSSIEIAGGVIIQ.
```

An encoding nucleic acid sequence of a mouse GFRAL protein is provided below:

```
                                      (SEQ ID NO: 1803)
AACAATTGAATTTGAATACAATTAGGAAAGTTCACAGCTCAAAACAAACT

GGTGAGGAACAGCTGACACCAGAAGCTGACTCTAATTGGCTGGCTCTTAG

GAAGCAAAACCTTTACACAGAAACTTCAGTTGGGATGTTGGTTGGTGTCA

GTTCATCCGCCTTTCTCCCAGGGAGACCATCTTGAGTTGTCCAACATGCT

AGTGTTCATTTTCCTGGCTGTTACGTTAAGCTCAGAAAATGAATCCTCTT

CCCAAACAAATGATTGTGCACATTTAATACAGAAATGCTTGATTGATGCA

AATGGCTGTGAGCAGTCATGGAGATCAATGGAAGACACCTGCCTTACTCC

AGGTGACTCCTGCAAGATAAATAATTCACTACATTGTAACCTGAGTATCC

AGGCTTTGGTGGAAAAAAATTTCCAATTTAAAGAGTGTCTTTGTATGGAT

GACCTCCACTGTACAGTAAACAAACTTTTTGGAAAAAAGTGCACCAATAA

GACAGATAACATGGAAAAGGACAATAAAGATAAATGGAATCTAACTACTA

CTCCTTTCTATCATGGATTCAAACAGATGCAGTCTTGTTTGGAGGTGACA

GAGGCGTGTGTAGGGGATGTGGTTTGTAATGCACAGTTGGCCCTTTACCT

TAAAGCATGCTCAGCAAATGGAAATCTGTGTGATGTGAAACACTGCCAAG

CAGCCATACGGTTCTTCTATCAAAATATGCCTTTTAACACTGCCCAGATG

TTGGCTTTTTGTGACTGTGCTCAATCTGATATACCCTGTCAGCAATCCAA

AGAAACTCTTCACAGCAAGCCATGTGCACTGAATATAGTTCCACCCCCCA

CTTGCCTCAGTGTAATTCACACTTGCCGAAATGATGAATTATGCAGGACA

CACTACCGAACATTCCAGACAGAATGCTGGCCCCACATAACTGGGAAGTG

CCATGAAGATGAGACCTGCATTAGCATGTTAGGCAAGCAAGACCTTACTT

GTTCTGGGAGTGAGAGCTGCAGGGCTGCCTTCCTAGGAACCTTTGGGACA

GTCCTGCAAGTACCCTGTGCTTGCAGGGGCGTTACACAGGCTGAAGAACA

CGTGTGCATGATTTTCCAGCACATGCTTCATAGCAAATCGTGTTTCAATT

ACCCAACTCCTAATGTCAAAGACATTTCCTCATATGAAAAAAGAATTCA

AAAGAAATTACTCTGACTGGATTCAATTCTTTCTTCAATGGAGAACTACT

CTATGTTGTTGTGTGCATGGCAGTTACCTGTGGAATTCTTTTCTTGGTGA

TGCTCAAGTTAAGGATACAAAGTGAAAAAAGAGATCCCTCATCCATCGAA

ATAGCTGGAGGTGTCATCATTCAGTGAGCTGCAGATCACTTACCAACCAC

ATGTCTGTGTGACTAACCAATGGAAAATTACATTTGCCAATAACGCAATT

TAAGATGGATTTGACAATATTTAGTCATTATATGTAACAGTGACTGGTAC

AGTAATATACCACAATGATCACAGATCTGTTTTTGTTTTTGTTTTTAATG

TTTGAGTAAATACTTGTTGTGGTGTCATAACTAGTTGATAACATTTTCTT

TAAAGACAACAGGTGTCATGTAAAATGTGACAAATTTGCTGGAAGACTAT

CAATCCACATATCAACTTCTATCTTATGGAACTAATCATAATTAGTGTGT

GCAGTTTTCTGAACAAGGTTATAGTTTTCCATTAAGTTGGTAAAATTAAA

ATGCTAAGTAGAATATTGAGTATACTTGTTATTTATATATTCTTACTTAG

TGTCCAATCATTAAACAAATTGGTAACATTGAACATATTTAGTTAGATGA

CTGCTTATGAAAATAAGAACTGACATCTTACAAATTTTATAATTTAAATA

GTATTGAATTTTACTTTTTATTTGGTATGTTAAGATTCATAATATATAAA

GCAGCTACATTGGTTGAGAAAAGTCAATGGTTACTCCAGTAATGATATAC

TTTGTGAATTTATTTATTTTTGCTAATTAATGATCCTGAATGTAATCATG

ATGAAATAAAAAAGACATACTTAAATTGCT.
```

An amino acid sequence of a GFRAL protein from rat, scientific name *Rattus norvegicus*, is provided below, which includes a signal peptide sequence (underlined residues):

```
                                      (SEQ ID NO: 1804)
mlvfiflavrlssenesssQTNDCAYFMRQCLTDTDGCKQSWRSMEDACL

VSGDSCKINNPLPCNLSIQSLVEKHFQFKGCLCTDDLHCTVNKIFGKKCT

NKTDSMKKDNKYKRNLTTPLYHDTGFKQMQSCLEVTEACVGDVVCNAQLA

LYLKACTANGNLCDVKHCQAAIRFFYQNMPFNTAQMLAFCDCAQSDIPCQ

QSKETLHSKPCALNVVPPPTCLSVIHTCRNDELCRTYYRTFQTECWPHVA

GKCREDETCISMLGKQDLTCSGSDSCRAAYLGTFGTVLQVPCACRSITQG

EEPLCMAFQHMLHSKSCFNYPTPNVKDISSYERKHSKEITLTGFNSPFSG

ELIYVVVCMVVTSGILSLVMLKLRIPSKKRDPAPIEIAGAVIIQ.
```

An encoding nucleic acid sequence of a rat GFRAL protein is provided below:

```
                                            (SEQ ID NO: 1805)
ACAAATGATTGTGCATATTTCATGCGGCAATGCTTGACTGATACAGATGG

CTGTAAGCAGTCATGGAGATCAATGGAAGACGCCTGCCTTGTCTCAGGTG

ACTCCTGCAAGATAAATAATCCATTGCCTTGTAACCTGAGTATCCAGTCT

TTGGTGGAAAAACATTTTCAATTTAAAGGGTGTCTTTGCACTGATGATCT

CCACTGTACAGTAAACAAAATTTTTGGAAAAAAGTGCACCAATAAGACAG

ATAGCATGAAAAAGATAATAAATACAAACGGAATCTAACTACTCCTTTA

TATCATGATACAGGATTCAAACAGATGCAGTCTTGTTTGGAAGTGACAGA

GGCGTGTGTAGGGGATGTGGTTTGTAATGCACAGTTGGCCCTTTACCTTA

AAGCATGCACAGCAAATGGAAATCTGTGTGATGTGAAACACTGCCAAGCG

GCCATACGGTTCTTCTATCAAAATATGCCTTTTAACACTGCCCAGATGTT

GGCTTTTTGTGACTGTGCTCAATCTGATATACCCTGTCAACAATCCAAAG

AAACTCTTCACAGCAAGCCATGTGCACTGAACGTAGTTCCACCCCCCACT

TGCCTCAGTGTAATTCACACTTGCCGAAATGATGAATTATGCAGGACATA

CTACCGAACATTCCAGACAGAATGCTGGCCCCATGTGGCTGGGAAGTGTC

GTGAAGATGAGACCTGCATTAGTATGCTGGGCAAGCAAGACCTTACTTGT

TCTGGGAGTGACAGCTGCAGGGCAGCCTACCTAGGAACCTTCGGGACAGT

CCTTCAGGTGCCGTGTGCTTGCAGAAGCATCACACAGGGTGAAGAACCCT

TGTGCATGGCTTTCCAGCACATGCTTCACAGCAAATCATGTTTCAATTAC

CCAACTCCTAATGTCAAAGACATTTCCTCATATGAAAGAAAGCATTCAAA

AGAAATTACCCTGACTGGATTCAATTCTCCCTTCAGTGGAGAACTAATCT

ATGTTGTTGTGTGCATGGTAGTTACCAGCGGGATTCTTTCCTTGGTGATG

CTCAAGCTAAGGATACCTAGTAAGAAAAGAGACCCCGCGCCCATCGAAAT

AGCTGGAGCTGTCATCATTCAGTGA.
```

A GFRAL protein or GFRAL also refers to a protein that has one or more alteration in the amino acid residues (e.g., at locations that are not conserved across variants and/or species) while retaining the conserved domains and having a biological activity similar to the naturally-occurring GFRAL. GFRAL may be encoded by nucleic acid sequences that vary in one or more bases from a naturally-occurring DNA sequence but still translate into an amino acid sequence that corresponds to the a naturally-occurring protein due to degeneracy of the genetic code. A GFRAL protein also refers to a protein that differs from the naturally-occurring sequences of GFRAL by one or more conservative substitutions and/or tags and/or conjugates.

The term "GFRAL" or "GFRAL protein" encompasses "full-length" unprocessed GFRAL as well as any form of GFRAL that results from processing in the cell. The term GFRAL or "GFRAL protein" also includes: allelic variants (e.g., SNP variants); splice variants; isoforms; fragments; derivatives; substitution, deletion, and insertion variants; fusion polypeptides; and interspecies homologs, preferably, which retain GFRAL activity and/or are sufficient to generate an anti-GFRAL immune response. As those skilled in the art will appreciate, an anti-GFRAL antibody provided herein can bind to a GFRAL protein, including a GFRAL polypeptide fragment, a GFRAL antigen, and/or a GFRAL epitope. An epitope may be part of a larger GFRAL antigen, which may be part of a larger GFRAL polypeptide fragment, which, in turn, may be part of a larger GFRAL protein. A GFRAL protein may exist in a native or denatured form.

GFRAL proteins described herein may be isolated from a variety of sources, such as from human tissue types or from another source, or prepared by recombinant or synthetic methods. A GFRAL protein may comprise a polypeptide having the same amino acid sequence as a corresponding GFRAL polypeptide derived from nature. GFRAL proteins encompass truncated or secreted forms of a GFRAL polypeptide (e.g., an extracellular domain sequence), variant forms (e.g., alternatively spliced forms) and allelic variants of the polypeptide. GFRAL polypeptides described herein (e.g., human GFRAL) may be isolated from a variety of sources, such as from human tissue types or from another source, or prepared by recombinant or synthetic methods.

A GFRAL protein can lack at least 5, at least 10, up to at least 50 or more amino acids relative to a naturally-occurring full-length GFRAL polypeptide. For example, the GFRAL protein may not contain the signal sequence based on the amino acid sequence of a naturally-occurring GFRAL polypeptide. A GFRAL protein may also contain the same or similar post-translational modifications as a naturally-occurring GFRAL polypeptide or may not contain a post-translational modification. For example, the protein may have the same or similar glycosylation pattern as those of a naturally-occurring GFRAL polypeptide or may contain no glycosylation. In other embodiments, the GFRL protein includes mutations relative to the sequence of naturally-occurring GFRAL protein that introduce a glycosylation site at a location not present in the naturally-occurring GFRAL protein.

In certain embodiments, a GFRAL protein may be expressed by a recombinant cell genetically modified to express the GFRAL protein on its cell surface. The cell may be present in a composition that includes an isolated GDF15 protein. In certain cases, the cell may additionally express a RET protein, for example the cell may express a RET protein endogenously without being genetically modified to include an exogenous sequence encoding the RET protein. In other embodiments, the cell may not express detectable levels of a RET protein and may be genetically modified to express a RET protein from an exogenous sequence.

Also disclosed herein are fragments of a GFRAL protein, such as GFRAL fragments that lack an intracellular domain present in native GFRAL protein, or the intracellular domain and the transmembrane domain present in native GFRAL protein, such as a native GFRAL depicted in FIG. 1. As noted above, a fragment of a GFRAL protein may also lack a signal sequence present in the native GFRAL and may or may not include a heterologous signal sequence. The fragment may lack the intracellular domain present in a native GFRAL protein but include the transmembrane domain.

The term "GFRAL-extracellular domain" ("GFRAL-ECD") includes full-length GFRAL ECDs, GFRAL ECD fragments, and GFRAL ECD variants. As used herein, the term "GFRAL ECD" refers to a GFRAL polypeptide with or without a signal peptide that lacks the intracellular and/or transmembrane domains. In some embodiments, a GFRAL ECD refers to a protein having the amino acid sequence that is at least 70% identical to the amino acid sequence of a human full-length GFRAL ECD having the amino acid sequence:

```
                                            (SEQ ID NO: 1806)
QTNNCTYLREQCLRDANGCKHAWRVMEDACNDSDPGDPCKMRNSSYCNLS

IQYLVESNFQFKECLCTDDFYCTVNKLLGKKCINKSDNVKEDKFKWNLTT

RSHHGFKGMWSCLEVAEACVGDVVCNAQLASYLKACSANGNPCDLKQCQA

AIRFFYQNIPFNIAQMLAFCDCAQSDIPCQQSKEALHSKTCAVNMVPPPT
```

-continued
CLSVIRSCQNDELCRRHYRTFQSKCWQRVTRKCHEDENCISTLSKQDLTC

SGSDDCKAAYIDILGTVLQVQCTCRTITQSEESLCKIFQHMLHRKSCFNY

PTLSNVKGMALYTRKHANKITLTGFHSPFNGE.

The term "full-length GFRAL ECD", as used herein, refers to a GFRAL ECD that extends to the last amino acid of the extracellular domain, and may or may not include an N-terminal signal peptide. However, it is noted that "full-length GFRAL ECD" also encompasses a GFRAL-ECD that is extended by 1, 2, 3, 4, 5, 6, 7, 8, 9, or 10 amino acids on the C-terminus to include amino acids residues of the transmembrane domain provided that the polypeptide is soluble. In other words, such a GFRAL ECD lacks a sufficient length of a transmembrane domain such that it is not anchored into a cell membrane. The phrase "full-length GFRAL ECD" also encompasses a GFRAL-ECD that is extended by 1, 2, 3, 4, 5, 6, 7, 8, 9, or 10 amino acids on the N-terminus to include amino acids residues of the signal peptide. In certain embodiments, a GFRAL ECD refers to a contiguous amino acid sequence that is at least 70%, 75%, 80%, 85%, 90%, 95%, 96%, 97%, 98%, 99% or more identical to a contiguous amino acid sequence depicted in FIG. 1 and lacks at least 30, 33, 35, 40, 45, 50, or 55 amino acids or more at the C-terminus of the GFRAL sequences depicted in FIG. 1.

A GFRAL ECD is not an ECD of TGFβ RII (Acc. Nos.: NM_001024847.2; NM_003242.5) or orthologs thereof. GFRAL ECD is distinct from ECD of TGFβ RI (Acc. Nos.: NP_001124388.1. NP_004603.1) or orthologs thereof. In certain embodiments, a GFRAL ECD may be a protein having the amino acid sequence that is at least 70%, 75%, 80%, 85%, 90%, 95%, 96%, 97%, 98%, 99% or more identical to SEQ ID NO: 1806.

As used herein, the term "GFRAL ECD fragment" refers to a GFRAL ECD having one or more residues deleted from the N and/or C terminus of the full-length ECD and that retains the ability to bind to GDF15. In some instances, a GFRAL ECD fragment may or may not include an N-terminal signal peptide. In some instances, a GFRAL ECD fragment is a human GFRAL ECD fragment that lacks 1, 5, 10, 15, 16, 17, 18, or 19 residues present at the N-terminus of the sequence:

(SEQ ID NO: 1807)
MIVFIFLAMGLSLENEYTSQTNNCTYLREQCLRDANGCKHAWRVMEDACN

DSDPGDPCKMRNSSYCNLSIQYLVESNFQFKECLCTDDFYCTVNKLLGKK

CINKSDNVKEDKFKWNLTTRSHHGFKGMWSCLEVAEACVGDVVCNAQLAS

YLKACSANGNPCDLKQCQAAIRFFYQNIPFNIAQMLAFCDCAQSDIPCQQ

SKEALHSKTCAVNMVPPPTCLSVIRSCQNDELCRRHYRTFQSKCWQRVTR

KCHEDENCISTLSKQDLTCSGSDDCKAAYIDILGTVLQVQCTCRTITQSE

ESLCKIFQHMLHRKSCFNYPTLSNVKGMALYTRKHANKITLTGFHSPFNG

E

Another exemplary GFRAL ECD fragment comprises the following amino acid sequence, which corresponds to Q20 to C316 of a full-length human precursor GFRAL protein:

(SEQ ID NO: 1808)
QTNNCTYLREQCLRDANGCKHAWRVMEDACNDSDPGDPCKMRNSSYCNLS

IQYLVESNFQFKECLCTDDFYCTVNKLLGKKCINKSDNVKEDKFKWNLTT

-continued
RSHHGFKGMWSCLEVAEACVGDVVCNAQLASYLKACSANGNPCDLKQCQA

AIRFFYQNIPFNIAQMLAFCDCAQSDIPCQQSKEALHSKTCAVNMVPPPT

CLSVIRSCQNDELCRRHYRTFQSKCWQRVTRKCHEDENCISTLSKQDLTC

SGSDDCKAAYIDILGTVLQVQCTCRTITQSEESLCKIFQHMLHRKSC

Yet another exemplary GFRAL ECD fragment comprises the following amino acid sequence, which corresponds to W115 to E351 of a full-length human precursor GFRAL protein:

(SEQ ID NO: 1809)
WNLTTRSHHGFKGMWSCLEVAEACVGDVVCNAQLASYLKACSANGNPCDL

KQCQAAIRFFYQNIPFNIAQMLAFCDCAQSDIPCQQSKEALHSKTCAVNM

VPPPTCLSVIRSCQNDELCRRHYRTFQSKCWQRVTRKCHEDENCISTLSK

QDLTCSGSDDCKAAYIDILGTVLQVQCTCRTITQSEESLCKIFQHMLHRK

SCFNYPTLSNVKGMALYTRKHANKITLTGFHSPFNGE.

The above exemplary GFRAL ECD fragment was used in various methods as described in the Examples, including to produce a crystal of a complex comprising a GFRAL protein and a GDF15 protein or a GFRAL protein and an exemplary anti-GFRAL antibody.

Within a GFRAL protein or GFRAL ECD there are three domains—domain 1 (D1), domain 2 (D2) and domain 3 (D3). In some embodiments, the amino acid sequence of an exemplary D1 domain are residues Q20 to S130 of SEQ ID NO: 1797. In some embodiments, the amino acid sequence of an exemplary D2 domain are residues C131 to C210 of SEQ ID NO: 1797. In some embodiments, the amino acid sequence of an exemplary D3 domain are residues C220 to C316 of SEQ ID NO: 1797. Certain properties of a GFRAL protein can be attributed to the activity and/or binding of these domains, including within the ECD. For example, as described herein, amino acid residues within D2 are identified as being core interaction interface amino acids and/or boundary interaction interface amino acids for a GFRAL protein binding to a GDF15 protein. Likewise, as described herein, amino acid residues within D3 are identified as being core interaction interface amino acids and/or boundary interaction interface amino acids for a GFRAL protein binding to a RET protein.

The term "core interaction interface amino acid" or grammatical equivalent thereof refers to an amino acid residue of a given protein that has at least one atom within less or equal to 4.5 Å from an interacting protein (e.g., an amino acid of a GFRAL protein that interacts with a GDF15 protein or a RET protein). A distance of 4.5 Å allows for atoms within a van der Waals radius plus a possible water-mediated hydrogen bond to form a bond with the interacting protein.

The term "boundary interaction interface amino acid" or grammatical equivalent thereof refers to an amino acid residue of a given protein that has at least one atom within less than or equal to 5 Å from a core interface amino acid on the given protein (e.g., an amino acid of a GFRAL protein that is within 5 Å of a core interaction interface amino acid of a GFRAL protein that interacts with a GDF15 protein or a RET protein). A distance of less than or equal to 5 Å allows proteins binding to residues less than 5 Å away from core interaction interface amino acids on a given protein to be within the van der Waals radius of an interacting protein.

As used herein, the term "GFRAL ECD variants" refers to GFRAL ECDs that contain amino acid additions, deletions, or substitutions and that remain capable of binding to GDF15. Such variants may be at least 80%, 85%, 90%, 92%, 95%, 97%, 98%, or 99% identical to a parent GFRAL ECD.

"Growth differentiation factor 15" or "GDF15," also known in the art as MIC-1 (macrophage inhibitory cytokine-1), PDF (prostate differentiation factor), PLAB (placental bone morphogenetic protein), NAG-1 (non-steroidal anti-inflammatory drugs (NSAIDs) activated gene), TGF-PL, and PTGFB, is a member of the transforming growth factor β (TGF-β) super-family. GDF15, which is synthesized as a 62 kDa intracellular precursor protein that is subsequently cleaved by a furin-like protease, is secreted as a 25 kDa disulfide-linked protein (see, e.g., Fairlie et al., *J. Leukoc. Biol* 65:2-5 (1999)). GDF15 mRNA is seen in several tissues, including liver, kidney, pancreas, colon and placenta, and GDF15 expression in liver can be significantly up-regulated during injury of organs such as the liver, kidneys, heart and lungs.

The GDF15 precursor is a 308 amino acid polypeptide (NCBI Ref. Seq. NP_004855.2; GI:153792495) containing a 29 amino acid signal peptide, a 167 amino acid pro-domain, and a mature domain of 112 amino acids which is excised from the pro-domain by furin-like proteases.

An amino acid sequence of a precursor human GDF15 polypeptide is provided below:

(SEQ ID NO: 1810)
MPGQELRTVNGSQMLLVLLVLSWLPHGGALSLAEASRASFPGPSELHSED

SRFRELRKRYEDLLTRLRANQSWEDSNTDLVPAPAVRILTPEVRLGSGGH

LHLRISRAALPEGLPEASRLHRALFRLSPTASRSWDVTRPLRRQLSLARP

QAPALHLRLSPPPSQSDQLLAESSSARPQLELHLRPQAARGRRRARARNG

DHCPLGPGRCCRLHTVRASLEDLGWADWVLSPREVQVTMCIGACPSQFRA

ANMHAQIKTSLHRLKPDTVPAPCCVPASYNPMVLIQKTDTGVSLQTYDDL

LAKDCHCI

Such a 308-amino acid GDF15 polypeptide is referred to as a "full-length" GDF15 polypeptide; a 112-amino acid GDF15 polypeptide (amino acids 197-308 of "full-length" GDF15) is a "mature" GDF15 polypeptide.

"GDF15" as used herein includes a protein having an amino acid sequence that is at least 65% identical to the amino acid sequence of a mature human GDF15 polypeptide. An amino acid sequence of a mature human GDF15 polypeptide is provided below:

(SEQ ID NO: 1811)
ARNGDHCPLGPGRCCRLHTVRASLEDLGWADWVLSPREVQVTMCIGACPS

QFRAANMHAQIKTSLHRLKPDTVPAPCCVPASYNPMVLIQKTDTGVSLQT

YDDLLAKDCHCI

The above exemplary mature human GDF15 was used in the various methods described as in the Examples, including to produce a crystal of a complex comprising a GFRAL protein and a GDF15 protein.

Unless otherwise indicated, the term "GDF15" refers to a 112 amino acid mature human sequence (e.g., SEQ ID NO: 1811). In addition, numerical references to particular GDF15 residues refer to a 112 amino acid mature sequence (e.g., residue 1 is Ala (A), and residue 112 is Ile (I) of SEQ ID NO: 1811). For example, while a GDF15 precursor amino acid sequence predicts three excision sites, resulting in three putative forms of "mature" human GDF15 (e.g., 110, 112 and 115 amino acids), the 112 amino acid mature sequence is accepted as being correct.

Within the context of the present disclosure, "GDF15" or "GDF15 protein" includes GDF15 orthologs, and modified forms thereof, from other mammalian species, and their use, including mouse (NP_035949; GI:170784848), chimpanzee (XP_009433302.1; GI:694973734), orangutan (XP_009251261.1 GI:686757768), Rhesus monkey (EHH29815; GI:355703324), giant panda (XP_002912774; GI:301753921), gibbon (XP_004089328.1; GI:441627981), guinea pig (XP_003465238; GI:348558868), ferret (AER98997; GI:355689945), cow (NP_001193227; GI:329664989), pig (NP_001167527; GI:291291599), dog (XP_541938; GI:57101740) and platypus (*Ornithorhynchus anatinus*; AFV61279; GI:410111209). Such exemplary GDF15 proteins are shown in FIG. 2, which includes an alignment of the various exemplary GDF15 proteins. A mature form of human GDF15 has approximately 67% amino acid identity to the mouse ortholog.

"RET," also known in the art as Ret Proto-Oncogene, Cadherin-Related Family Member 16, Rearranged During Transfection, RET Receptor Tyrosine Kinase, Cadherin Family Member 12, Proto-Oncogene C-Ret, EC 2.7.10.1, CDHF12, CDHR16, RET51, PTC, Hydroxyaryl-Protein Kinase, RET Transforming Sequence, and Receptor Tyrosine Kinase, is one of the receptor tyrosine kinases, cell-surface molecules that transduce signals for cell growth and differentiation. RET acts as a co-receptor and is known as a primary signaling receptor for glial-cell-line-derived neurotrophic factor (GDNF) ligands (in human, GDNF, artemin, neurturin, and persephin) when bound to members of the GDNF receptor alpha (GFRα) co-receptors. A RET protein (e.g., a RET-ECD) comprises 4 consecutive cadherin-like domains (CLD1-CLD4) followed by a membrane proximal cystine rich domain (CRD). As disclosed herein, a RET protein is a co-receptor with a GFRAL protein and a GDF15 protein (e.g., acting as a co-receptor with a RET protein). A receptor complex, as described herein, includes a GFRAL protein, such as a RET/GFRAL complex, a GFRAL/GDF15 complex, and a RET/GFRAL/GDF15 complex.

As used herein, "Ret" or "RET" refers to a protein having the amino acid sequence that is at least 75% identical, e.g., 77%, 79%, 80%, 85%, 90%, 95%, 96%, 97%, 98%, 99% or more identical to the amino acid sequence of SEQ ID NO: 1813. RET is distinct from TGFβ RI and TGFβ RII. SEQ ID NO: 1812 is the sequence of a mature human RET9 that lacks a signal peptide:

(SEQ ID NO: 1812)
KVALGLYFSRDAYWEKLYVDQAAGTPLLYVHALRDAPEEVPSFRLGQHLY

GTYRTRLHENNWICIQEDTGLLYLNRSLDHSSWEKLSVRNRGFPLLTVYL

KVFLSPTSLREGECQWPGCARVYFSFFNTSFPACSSLKPRELCFPETRPS

FRIRENRPPGTFHQFRLLPVQFLCPNISVAYRLLEGEGLPFRCAPDSLEV

STRWALDREQREKYELVAVCTVHAGAREEVVMVPFPVTVYDEDDSAPTFP

AGVDTASAVVEFKRKEDTVVATLRVFDADVVPASGELVRRYTSTLLPGDT

WAQQTFRVEHWPNETSVQANGSFVRATVHDYRLVLNRNLSISENRTMQLA

VLVNDSDFQGPGAGVLLLHFNVSVLPVSLHLPSTYSLSVSRRARRFAQIG

KVCVENCQAFSGINVQYKLHSSGANCSTLGVVTSAEDTSGILFVNDTKAL

RRPKCAELHYMVVATDQQTSRQAQAQLLVTVEGSYVAEEAGCPLSCAVSK

-continued

```
RRLECEECGGLGSPTGRCEWRQGDGKGITRNFSTCSPSTKTCPDGHCDVV

ETQDINICPQDCLRGSIVGGHEPGEPRGIKAGYGTCNCFPEEEKCFCEPE

DIQDPLCDELCRTVIAAAVLFSFIVSVLLSAFCIHCYHKFAHKPPISSAE

MTFRRPAQAFPVSYSSSGARRPSLDSMENQVSVDAFKILEDPKWEFPRKN

LVLGKTLGEGEFGKVVKATAFHLKGRAGYTTVAVKMLKENASPSELRDLL

SEFNVLKQVNHPHVIKLYGACSQDGPLLLIVEYAKYGSLRGFLRESRKVG

PGYLGSGGSRNSSSLDHPDERALTMGDLISFAWQISQGMQYLAEMKLVHR

DLAARNILVAEGRKMKISDFGLSRDVYEEDSYVKRSQGRIPVKWMAIESL

FDHIYTTQSDVWSFGVLLWEIVTLGGNPYPGIPPERLFNLLKTGHRMERP

DNCSEEMYRLMLQCWKQEPDKRPVFADISKDLEKMMVKRRDYLDLAASTP

SDSLIYDDGLSEEETPLVDCNNAPLPRALPSTWIENKLYGRISHAFTRF
```

The amino acid sequence of a full-length precursor human RET protein is provided below, which includes a signal peptide sequence (underlined and lowercase residues):

```
                                          (SEQ ID NO: 1813)
makatsgaaglrlllllllpllgkvalgLYFSRDAYWEKLYVDQAAGTPL

LYVHALRDAPEEVPSFRLGQHLYGTYRTRLHENNWICIQEDTGLLYLNRS

LDHSSWEKLSVRNRGFPLLTVYLKVFLSPTSLREGECQWPGCARVYFSFF

NTSFPACSSLKPRELCFPETRPSFRIRENRPPGTFHQFRLLPVQFLCPNI

SVAYRLLEGEGLPFRCAPDSLEVSTRWALDREQREKYELVAVCTVHAGAR

EEVVMVPFPVTVYDEDDSAPTFPAGVDTASAVVEFKRKEDTVVATLRVFD

ADVVPASGELVRRYTSTLLPGDTWAQQTFRVEHWPNETSVQANGSFVRAT

VHDYRLVLNRNLSISENRTMQLAVLVNDSDFQGPGAGVLLLHFNVSVLPV

SLHLPSTYSLSVSRRARRFAQIGKVCVENCQAFSGINVQYKLHSSGANCS

TLGVVTSAEDTSGILFVNDTKALRRPKCAELHYMVVATDQQTSRQAQAQL

LVTVEGSYVAEEAGCPLSCAVSKRRLECEECGGLGSPTGRCEWRQGDGKG

ITRNFSTCSPSTKTCPDGHCDVVETQDINICPQDCLRGSIVGGHEPGEPR

GIKAGYGTCNCFPEEEKCFCEPEDIQDPLCDELCRTVIAAAVLFSFIVSV

LLSAFCIHCYHKFAHKPPISSAEMTFRRPAQAFPVSYSSSGARRPSLDSM

ENQVSVDAFKILEDPKWEFPRKNLVLGKTLGEGEFGKVVKATAFHLKGRA

GYTTVAVKMLKENASPSELRDLLSEFNVLKQVNHPHVIKLYGACSQDGPL

LLIVEYAKYGSLRGFLRESRKVGPGYLGSGGSRNSSSLDHPDERALTMGD

LISFAWQISQGMQYLAEMKLVHRDLAARNILVAEGRKMKISDFGLSRDVY

EEDSYVKRSQGRIPVKWMAIESLFDHIYTTQSDVWSFGVLLWEIVTLGGN

PYPGIPPERLFNLLKTGHRMERPDNCSEEMYRLMLQCWKQEPDKRPVFAD

ISKDLEKMMVKRRDYLDLAASTPSDSLIYDDGLSEEETPLVDCNNAPLPR

ALPSTWIENKLYGRISHAFTRF
```

Accordingly, "RET" or a "RET protein" as used herein encompasses human RET and variants thereof, including but not limited to orthologs thereof, such as murine RET, cyno RET, and the like. In certain embodiments, RET may be a protein having the amino acid sequence that is at least 75%, 80%, 85%, 90%, 95%, 96%, 97%, 98%, 99% or more identical to SEQ ID NO: 1813.

In certain embodiments, an isolated RET-extracellular domain (RET-ECD) polypeptide is provided. A RET-ECD may be bound to a ligand such as a GFRAL protein when present in an isolated protein complex of the present disclosure. The term "RET-extracellular domain" ("RET-ECD") includes full-length RET ECDs, RET ECD fragments, and RET ECD variants. As used herein, the term "RET ECD" refers to a RET polypeptide with or without a signal peptide that lacks the intracellular and transmembrane domains. In some embodiments, a RET ECD refers to a protein having an amino acid sequence that is at least 75% identical to the amino acid sequence of human full-length RET ECD having the amino acid sequence:

```
                                          (SEQ ID NO: 1814)
KVALGLYFSRDAYWEKLYVDQAAGTPLLYVHALRDAPEEVPSFRLGQHLY

GTYRTRLHENNWICIQEDTGLLYLNRSLDHSSWEKLSVRNRGFPLLTVYL

KVFLSPTSLREGECQWPGCARVYFSFFNTSFPACSSLKPRELCFPETRPS

FRIRENRPPGTFHQFRLLPVQFLCPNISVAYRLLEGEGLPFRCAPDSLEV

STRWALDREQREKYELVAVCTVHAGAREEVVMVPFPVTVYDEDDSAPTFP

AGVDTASAVVEFKRKEDTVVATLRVFDADVVPASGELVRRYTSTLLPGDT

WAQQTFRVEHWPNETSVQANGSFVRATVHDYRLVLNRNLSISENRTMQLA

VLVNDSDFQGPGAGVLLLHFNVSVLPVSLHLPSTYSLSVSRRARRFAQIG

KVCVENCQAFSGINVQYKLHSSGANCSTLGVVTSAEDTSGILFVNDTKAL

RRPKCAELHYMVVATDQQTSRQAQAQLLVTVEGSYVAEEAGCPLSCAVSK

RRLECEECGGLGSPTGRCEWRQGDGKGITRNFSTCSPSTKTCPDGHCDVV

ETQDINICPQDCLRGSIVGGHEPGEPRGIKAGYGTCNCFPEEEKCFCEPE

DIQDPLCDELCR
```

In another exemplary embodiment, the a RET ECD refers to a protein having a amino acid sequence that is at least 75% identical to the amino acid sequence of a human full-length RET ECD having the amino acid sequence:

```
                                          (SEQ ID NO: 1815)
LYFSRDAYWEKLYVDQAAGTPLLYVHALRDAPEEVPSFRLGQHLYGTYRT

RLHENNWICIQEDTGLLYLNRSLDHSSWEKLSVRNRGFPLLTVYLKVFLS

PTSLREGECQWPGCARVYFSFFNTSFPACSSLKPRELCFPETRPSFRIRE

NRPPGTFHQFRLLPVQFLCPNISVAYRLLEGEGLPFRCAPDSLEVSTRWA

LDREQREKYELVAVCTVHAGAREEVVMVPFPVTVYDEDDSAPTFPAGVDT

ASAVVEFKRKEDTVVATLRVFDADVVPASGELVRRYTSTLLPGDTWAQQT

FRVEHWPNETSVQANGSFVRATVHDYRLVLNRNLSISENRTMQLAVLVND

SDFQGPGAGVLLLHFNVSVLPVSLHLPSTYSLSVSRRARRFAQIGKVCVE

NCQAFSGINVQYKLHSSGANCSTLGVVTSAEDTSGILFVNDTKALRRPKC

AELHYMVVATDQQTSRQAQAQLLVTVEGSYVAEEAGCPLSCAVSKRRLEC

EECGGLGSPTGRCEWRQGDGKGITRNFSTCSPSTKTCPDGHCDVVETQDI

NICPQDCLRGSIVGGHEPGEPRGIKAGYGTCNCFPEEEKCFCEPEDIQDP

LCDELCR
```

The term "full-length RET ECD", as used herein, refers to a RET ECD that extends to the last amino acid of an extracellular domain, and may or may not include an N-terminal signal peptide. However, it is noted that "full-length RET ECD" also encompasses a RET-ECD that is extended by 1, 2, 3, 4, 5, 6, 7, 8, 9, or 10 amino acids on the C-terminus to include amino acids residues of the transmembrane domain provided that the polypeptide is soluble. In other words, a RET ECD lacks a sufficient length of a transmembrane domain such that it is not anchored into a cell membrane. The phrase "full-length RET ECD" also encompasses a RET-ECD that is extended by 1, 2, 3, 4, 5, 6, 7, 8, 9, or 10 amino acids on the N-terminus to include amino acids residues of the signal peptide. In certain embodiments, RET fragment refers to a contiguous amino acid sequence that is at least 70%, 75%, 80%, 85%, 90%, 95%, 96%, 97%, 98%, 99% or more identical to a contiguous amino acid sequence of RET described herein and lacks at least 30, 33, 35, 40, 45, 50, or 55 amino acids or more at the C-terminus of RET sequences described herein.

As used herein, the term "RET ECD fragment" refers to a RET ECD having one or more residues deleted from the N and/or C terminus of a full-length ECD and that retains the ability to bind to a GFRAL protein. In some instances, a RET ECD fragment may or may not include an N-terminal signal peptide. In some instances, a RET ECD fragment is a human RET ECD fragment that lacks 1, 5, 10, 15, 16, 17, 18, or 19 residues present at the N-terminus of the sequence:

(SEQ ID NO: 1816)
LYFSRDAYWEKLYVDQAAGTPLLYVHALRDAPEEVPSFRLGQHLYGTYRT

RLHENNWICIQEDTGLLYLNRSLDHSSWEKLSVRNRGFPLLTVYLKVFLS

PTSLREGECQWPGCARVYFSFFNTSFPACSSLKPRELCFPETRPSFRIRE

NRPPGTFHQFRLLPVQFLCPNISVAYRLLEGEGLPFRCAPDSLEVSTRWA

LDREQREKYELVAVCTVHAGAREEVVMVPFPVTVYDEDDSAPTFPAGVDT

ASAVVEFKRKEDTVVATLRVFDADVVPASGELVRRYTSTLLPGDTWAQQT

FRVEHWPNETSVQANGSFVRATVHDYRLVLNRNLSISENRTMQLAVLVND

SDFQGPGAGVLLLHFNVSVLPVSLHLPSTYSLSVSRRARRFAQIGKVCVE

NCQAFSGINVQYKLHSSGANCSTLGVVTSAEDTSGILFVNDTKALRRPKC

AELHYMVVATDQQTSRQAQAQLLVTVEGSYVAEEAGCPLSCAVSKRRLEC

EECGGLGSPTGRCEWRQGDGKGITRNFSTCSPSTKTCPDGHCDVVETQDI

NICPQDCLRGSIVGGHEPGEPRGIKAGYGTCNCFPEEEKCFCEPEDIQDP

LCDELCR

The above exemplary RET ECD fragment was used in various methods described in the Examples, including to produce a model of a complex comprising a RET protein, a GFRAL protein and a GDF15 protein.

In alternative embodiments of a RET ECD, the RET-ECD comprises a C64R, N75Q, N166Q, or C183S mutation in a RET ECD sequence of human full-length RET ECD SEQ ID NO 1814.

The phrase "modulates the activity and/or signaling," when applied to a binding protein, such an antibody that binds to GFRAL of the present disclosure, means that the binding protein (e.g., antibody) mimics or modulates an in vitro or an in vivo biological effect induced by the binding of: (i) a GFRAL protein; (ii) a GDF15 protein and a GFRAL protein; or (iii) a GDF15 protein, a GFRAL protein, and a RET protein. In assessing the binding and specificity of anti-GFRAL antibody, for example, an antibody or fragment thereof, that binds to a GFRAL protein (e.g., a human GFRAL protein), is deemed to induce a biological response when the response is equal to or less than 95%, and preferably equal to or less than 10%, 15%, 20%, 25%, 30%, 35%, 40%, 45%, 50%, 55%, 60%, 65%, 70%, 75%, 80%, 85%, 90% or 95%, of the activity of a wild type GFRAL standard (e.g., the mature form of a human GFRAL protein). An antibody or fragment thereof, that binds to GFRAL (e.g., human GFRAL), is also deemed to induce a biological response when it has one or more of the following properties: exhibiting an efficacy level of equal to or less than 95% of a GFRAL standard, with an IC50 of equal to or less than 100 nM, e.g., 90 nM, 80 nM, 70 nM, 60 nM, 50 nM, 40 nM, 30 nM, 20 nM, 10 nM, 1 nM, 0.1 nM 0.01 nM in (1) a ELK1-luciferase reporter assay (see, e.g., Example 3); or (2) ERK-phosphorylation assay in U2OS cells (see, e.g., Example 4).

The term "binding protein" refers to a protein comprising a portion (e.g., one or more binding regions such as CDRs) that binds to a GFRAL protein, including a human GFRAL protein and, optionally, a scaffold or framework portion (e.g., one or more scaffold or framework regions) that allows the binding portion to adopt a conformation that promotes binding of the binding protein to a GFRAL polypeptide, fragment or epitope. Examples of such binding proteins include antibodies, such as a human antibody, a humanized antibody; a chimeric antibody; a recombinant antibody; a single chain antibody; a diabody; a triabody; a tetrabody; a Fab fragment; a F(ab') 2 fragment; an IgD antibody; an IgE antibody; an IgM antibody; an IgG1 antibody; an IgG2 antibody; an IgG3 antibody; or an IgG4 antibody, and fragments thereof. The binding protein can comprise, for example, an alternative protein scaffold or artificial scaffold with grafted CDRs or CDR derivatives. Such scaffolds include, but are not limited to, antibody-derived scaffolds comprising mutations introduced to, for example, stabilize the three-dimensional structure of the binding protein as well as wholly synthetic scaffolds comprising, for example, a biocompatible polymer. See, e.g., Korndorfer et al., 2003, Proteins: Structure, Function, and Bioinformatics, 53(1): 121-129 (2003); Roque et al., Biotechnol. Prog. 20:639-654 (2004). In addition, peptide antibody mimetics ("PAMs") can be used, as well as scaffolds based on antibody mimetics utilizing fibronectin components as a scaffold. In the context of the present disclosure, a binding protein is said to specifically bind or selectively bind to GFRAL, for example, when the dissociation constant ($K_D$) is $\leq 10^{-8}$ M. The binding protein (e.g., antibody) may specifically bind GFRAL with high affinity when the $K_D$ is $\leq 10^{-9}$ M or $K_D$ is $\leq 10^{-10}$ M. In some embodiments, the binding proteins (e.g., antibodies) may bind to GFRAL, including with a $K_D$ of between about $10^{-7}$ M and about $10^{-12}$ M and in other embodiments, the binding proteins (e.g., antibodies) may bind with a $K_D$ of $1$-$2 \times 10^{-9}$ M.

The term "antibody" and "immunoglobulin" or "Ig" are used interchangeably herein, and is used in the broadest sense and specifically covers, for example, individual anti-GFRAL monoclonal antibodies (including agonist, antagonist, neutralizing antibodies, full length or intact monoclonal antibodies), anti-GFRAL antibody compositions with polyepitopic or monoepitopic specificity, polyclonal or monovalent antibodies, multivalent antibodies, multispecific antibodies (e.g., bispecific antibodies so long as they exhibit the desired biological activity), formed from at least two intact antibodies, single chain anti-GFRAL antibodies, and fragments of anti-GFRAL antibodies, as described below. An antibody can be human, humanized, chimeric and/or affinity matured as well as an antibody from other species, for example mouse, rabbit etc. The term "antibody" is intended to include a polypeptide product of B cells within the immunoglobulin class of polypeptides that is able to bind to a specific molecular antigen and is composed of two identical pairs of polypeptide chains, wherein each pair has one heavy chain (about 50-70 kDa) and one light chain (about 25 kDa) and each amino-terminal portion of each chain includes a variable region of about 100 to about 130 or more amino acids and each carboxy-terminal portion of each chain includes a constant region (See, Borrebaeck (ed.) (1995) Antibody Engineering, Second Ed., Oxford University Press.; Kuby (1997) Immunology, Third Ed., W.H. Freeman and Company, New York). In specific embodiments, the specific molecular antigen can be bound by an antibody provided herein includes a GFRAL polypeptide, GFRAL fragment or GFRAL epitope. Antibodies also include, but are not limited to, synthetic antibodies, monoclonal antibodies, recombinantly produced antibodies, multispecific antibodies (including bi-specific antibodies), human antibodies, humanized antibodies, camelized antibodies, chimeric antibodies, intrabodies, anti-idiotypic (anti-Id) antibodies, and functional fragments (e.g., antigens-binding fragments such as GFRAL binding fragments) of any of the above, which refers a portion of an antibody heavy or light chain polypeptide that retains some or all of the binding activity of the antibody from which the fragment was derived. Non-limiting examples of functional fragments (e.g., antigens-binding fragments such as GFRAL binding fragments) include single-chain Fvs (scFv) (e.g., including monospecific, bispecific, etc.), Fab fragments, F(ab') fragments, F(ab)2 fragments, F(ab')2 fragments, disulfide-linked Fvs (sdFv), Fd fragments, Fv fragments, diabody, triabody, tetrabody and minibody. In particular, antibodies provided herein include immunoglobulin molecules and immunologically active portions of immunoglobulin molecules, for example, antigen binding domains or molecules that contain an antigen-binding site that binds to a GFRAL antigen (e.g., one or more complementarity determining regions (CDRs) of an anti-GFRAL antibody). Such antibody fragments can be found described in, for example, Harlow and Lane, Antibodies: A Laboratory Manual, Cold Spring Harbor Laboratory, New York (1989); Myers (ed.), Molec. Biology and Biotechnology: A Comprehensive Desk Reference, New York: VCH Publisher, Inc.; Huston et al., Cell Biophysics, 22:189-224 (1993); Plückthun and Skerra, Meth. Enzymol., 178:497-515 (1989) and in Day, E. D., Advanced Immunochemistry, Second Ed., Wiley-Liss, Inc., New York, N.Y. (1990). The antibodies provided herein can be of any type (e.g., IgG, IgE, IgM, IgD, IgA and IgY), any class (e.g., IgG1, IgG2, IgG3, IgG4, IgA1 and IgA2), or any subclass (e.g., IgG2a and IgG2b) of immunoglobulin molecule. Anti-GFRAL antibodies may be agonistic antibodies or antagonistic antibodies. Antibodies provided herein include antagonistic antibodies to GFRAL, for example, antibodies that inhibit GFRAL signaling. Exemplary anti-GFRAL antibodies include antibodies with CDRs as shown in Tables 1-24.

The terms "about" or "approximately" mean within 20%, within 15%, within 10%, within 9%, within 8%, within 7%, within 6%, within 5%, within 4%, within 3%, within 2%, within or 1% or less of a given value or range.

An "antigen" is a predetermined antigen to which an antibody can selectively bind. A target antigen may be a polypeptide, carbohydrate, nucleic acid, lipid, hapten or other naturally occurring or synthetic compound. In some embodiments, the target antigen is a polypeptide.

The term "antigen binding fragment," "antigen binding domain," "antigen binding region," and similar terms refer to that portion of an antibody which comprises the amino acid residues that interact with an antigen and confer on the binding agent its specificity and affinity for the antigen (e.g., the complementarity determining regions (CDRs)).

The terms "binds" or "binding" refer to an interaction (e.g., covalent or non-covalent) between molecules including, for example, to form a complex. A complex can also include the binding of two or more molecules held together by covalent or non-covalent bonds, interactions or forces. Interactions can be, for example, non-covalent interactions including hydrogen bonds, ionic bonds, hydrophobic interactions, and/or van der Waals interactions. The strength of the total non-covalent interactions between a single antigen-binding site on an antibody and a single epitope of a target molecule, such as GFRAL, is the affinity of the antibody or functional fragment for that epitope. The ratio of association (k1) to dissociation (k−1) of an antibody to a monovalent antigen (k1/k−1) is the association constant K, which is a measure of affinity. The value of K varies for different complexes of antibody and antigen and depends on both k1 and k−1. The association constant K for an antibody provided herein can be determined using any method provided herein or any other method well known to those skilled in the art. The affinity at one binding site does not always reflect the true strength of the interaction between an antibody and an antigen. When complex antigens containing multiple, repeating antigenic determinants, such as a polyvalent GFRAL, come in contact with antibodies containing multiple binding sites, the interaction of antibody with antigen at one site will increase the probability of a reaction at a second site. The strength of such multiple interactions between a multivalent antibody and antigen is called the avidity. The avidity of an antibody can be a better measure of its binding capacity than is the affinity of its individual binding sites. For example, high avidity can compensate for low affinity as is sometimes found for pentameric IgM antibodies, which can have a lower affinity than IgG, but the high avidity of IgM, resulting from its multivalence, enables it to bind antigen effectively.

The terms "antibodies that specifically bind to GFRAL," "antibodies that specifically bind to a GFRAL epitope," and analogous terms are also used interchangeably herein and refer to antibodies that specifically bind to a GFRAL polypeptide, such as a GFRAL antigen, or fragment, or epitope (e.g., human GFRAL such as a human GFRAL polypeptide, antigen or epitope). An antibody that specifically binds to GFRAL, (e.g., human GFRAL) may bind to the extracellular domain or peptide derived from the extracellular domain of GFRAL. An antibody that specifically binds to a GFRAL antigen (e.g., human GFRAL) may be cross-reactive with related antigens (e.g., cyno GFRAL). In certain embodiments, an antibody that specifically binds to a GFRAL antigen does not cross-react with other antigens. An antibody that specifically binds to a GFRAL antigen can be identified, for example, by immunoassays, Biacore, or other techniques known to those of skill in the art. An antibody binds specifically to a GFRAL antigen when it binds to a GFRAL antigen with higher affinity than to any cross reactive antigen as determined using experimental techniques, such as radioimmunoassays (RIA) and enzyme linked immunosorbent assays (ELISAs). Typically a specific or selective reaction will be at least twice background signal or noise and may be more than 10 times background. See, e.g., Paul, ed., 1989, *Fundamental Immunology Second Edition*, Raven Press, New York at pages 332

336 for a discussion regarding antibody specificity. An antibody "which binds" an antigen of interest (e.g., a target antigen such as GFRAL) is one that binds the antigen with sufficient affinity such that the antibody is useful as a therapeutic agent in targeting a cell or tissue expressing the antigen, and does not significantly cross-react with other proteins. In such embodiments, the extent of binding of the antibody to a "non-target" protein will be less than about 10% of the binding of the antibody to its particular target protein, for example, as determined by fluorescence activated cell sorting (FACS) analysis or radioimmunoprecipitation (RIA). With regard to the binding of an antibody to a target molecule, the term "specific binding" or "specifically binds to" or is "specific for" a particular polypeptide or an epitope on a particular polypeptide target means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target, for example, an excess of non-labeled target. In this case, specific binding is indicated if the binding of the labeled target to a probe is competitively inhibited by excess unlabeled target. The term "specific binding" or "specifically binds to" or is "specific for" a particular polypeptide or an epitope on a particular polypeptide target as used herein can be exhibited, for example, by a molecule having a Kd for the target of at least about $10^{-4}$M, alternatively at least about $10^{-5}$ M, alternatively at least about $10^{-6}$ M, alternatively at least about $10^{-7}$ M, alternatively at least about $10^{-8}$ M, alternatively at least about $10^{-9}$ M, alternatively at least about $10^{-10}$ M, alternatively at least about $10^{-11}$ M, alternatively at least about $10^{-12}$ M, or greater. In one embodiment, the term "specific binding" refers to binding where a molecule binds to a particular polypeptide or epitope on a particular polypeptide without substantially binding to any other polypeptide or polypeptide epitope. In certain embodiments, an antibody that binds to GFRAL has a dissociation constant (Kd) of less than or equal to 10 nM, 5 nM, 4 nM, 3 nM, 2 nM, 1 nM, 0.9 nM, 0.8 nM, 0.7 nM, 0.6 nM, 0.5 nM, 0.4 nM, 0.3 nM, 0.2 nM, or 0.1 nM. The lower the $K_D$, the higher the affinity of the anti-GFRAL antibody. In certain embodiments, anti-GFRAL antibody binds to an epitope of GFRAL that is conserved among GFRAL from different species (e.g., between human and cyno GFRAL).

The term "compete" when used in the context of anti-GFRAL antibodies (e.g., antagonistic antibodies and binding proteins that bind to GFRAL) that bind to or compete for the same epitope or binding site on a target means competition between as determined by an assay in which the antibody (or binding fragment) thereof under study prevents or inhibits the specific binding of a reference molecule (e.g., a reference ligand, or reference antigen binding protein, such as a reference antibody) to a common antigen (e.g., GFRAL or a fragment thereof). Numerous types of competitive binding assays can be used to determine if a test antibody competes with a reference antibody for binding to GFRAL (e.g., human GFRAL). Examples of assays that can be employed include solid phase direct or indirect radioimmunoassay (RIA), solid phase direct or indirect enzyme immunoassay (EIA), sandwich competition assay (see, e.g., Stahli et al., (1983) Methods in Enzymology 9:242-253); solid phase direct biotin-avidin EIA (see, e.g., Kirkland et al., (1986) J. Immunol. 137:3614-3619) solid phase direct labeled assay, solid phase direct labeled sandwich assay (see, e.g., Harlow and Lane, (1988) Antibodies, A Laboratory Manual, Cold Spring Harbor Press); solid phase direct label RIA using 1-125 label (see, e.g., Morel et al., (1988) Molec. Immunol. 25:7-15); solid phase direct biotin-avidin EIA (see, e.g., Cheung, et al., (1990) Virology 176:546-552); and direct labeled RIA (Moldenhauer et al., (1990) Scand. J. Immunol. 32:77-82). Typically, such an assay involves the use of a purified antigen (e.g., GFRAL such as human GFRAL) bound to a solid surface or cells bearing either of an unlabelled test antigen binding protein (e.g., test anti-GFRAL antibody) or a labeled reference antigen binding protein (e.g., reference anti-GFRAL antibody). Competitive inhibition may be measured by determining the amount of label bound to the solid surface or cells in the presence of the test antigen binding protein. Usually the test antigen binding protein is present in excess. Antibodies identified by competition assay (competing antibodies) include antibodies binding to the same epitope as the reference antibody and/or antibodies binding to an adjacent epitope sufficiently proximal to the epitope bound by the reference for antibodies steric hindrance to occur. Additional details regarding methods for determining competitive binding and/or binding to the same epitope are described herein. Usually, when a competing antibodies protein is present in excess, it will inhibit specific binding of a reference antibodies to a common antigen by at least 23%, for example 40%, 45%, 50%, 55%, 60%, 65%, 70% or 75%. In some instance, binding is inhibited by at least 80%, 85%, 90%, 95%, 96% or 97%, 98%, 99% or more.

The term "anti-GFRAL antibody" or "an antibody that binds to GFRAL" includes an antibody that is capable of binding GFRAL with sufficient affinity such that the antibody is useful as a diagnostic and/or therapeutic agent in targeting GFRAL. In certain embodiments, the extent of binding of an anti-GFRAL antibody to an unrelated, non-GFRAL protein is less than about 10% of the binding of the antibody to GFRAL as measured, for example, by fluorescence activated cell sorting (FACS) analysis or an immunoassay such as a radioimmunoassay (RIA). An antibody that "specifically binds to" or is "specific for" GFRAL is illustrated herein. In certain embodiments, an antibody that binds to GFRAL, as described herein, has a dissociation constant (Kd) of less than or equal to 10 nM, 9 nM, 8 nM, 7 nM, 6 nM, 5 nM, 4 nM, 0.9 nM, 0.8 nM, 0.7 nM, 0.6 nM, 0.5 nM, 0.4 nM, 0.3 nM, 0.2 nM, or 0.1 nM, and/or is greater than or equal to 0.1 nM. In certain embodiments, anti-GFRAL antibody binds to an epitope of GFRAL that is conserved among GFRAL from different species (e.g., between human and cyno GFRAL).

The terms "crystal", and "crystallized" as used herein, refer to one or more proteins or fragments thereof that exist in the form of a crystal. Crystals are one form of the solid state of matter, which is distinct from other forms such as the amorphous solid state or the liquid crystalline state. Crystals are composed of regular, repeating, three-dimensional arrays of atoms, ions, molecules (e.g., proteins such as antibodies), or molecular assemblies (e.g., ligand/receptor or antigen/antibody complexes). These three-dimensional arrays are arranged according to specific mathematical relationships that are well-understood in the field. The fundamental unit, or building block, that is repeated in a crystal is called the asymmetric unit. Repetition of the asymmetric unit in an arrangement that conforms to a given, well-defined crystallographic symmetry provides the "unit cell" of the crystal. Repetition of the unit cell by regular translations in all three dimensions provides the crystal. See Giege, R. and Ducruix, A. Barrett, Crystallization of Nucleic Acids and Proteins, a Practical Approach, 2nd ea., pp. 20 1-16, Oxford University Press, New York, N.Y., (1999).

An "isolated" antibody is substantially free of cellular material or other contaminating proteins from the cell or tissue source and/or other contaminant components from which the antibody is derived, or substantially free of chemical precursors or other chemicals when chemically synthesized. The language "substantially free of cellular material" includes preparations of an antibody in which the antibody is separated from cellular components of the cells from which it is isolated or recombinantly produced. Thus, an antibody that is substantially free of cellular material includes preparations of antibody having less than about 30%, 25%, 20%, 15%, 10%, 5%, or 1% (by dry weight) of heterologous protein (also referred to herein as a "contaminating protein"). In certain embodiments, when the antibody is recombinantly produced, it is substantially free of culture medium, e.g., culture medium represents less than about 20%, 15%, 10%, 5% or 1% of the volume of the protein preparation. In certain embodiments, when the antibody is produced by chemical synthesis, it is substantially free of chemical precursors or other chemicals, for example, it is separated from chemical precursors or other chemicals which are involved in the synthesis of the protein. Accordingly such preparations of the antibody have less than about 30%, 25%, 20%, 15%, 10%, 5%, or 1% (by dry weight) of chemical precursors or compounds other than the antibody of interest. Contaminant components can also include, but are not limited to, materials that would interfere with therapeutic uses for the antibody, and may include enzymes, hormones, and other proteinaceous or nonproteinaceous solutes. In certain embodiments, the antibody will be purified (1) to greater than 95% by weight of antibody as determined by the Lowry method (Lowry et al. J. Bio. Chem. 193: 265-275, 1951), such as 96%, 97%, 98%, or 99%, by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step. In specific embodiments, antibodies provided herein are isolated.

A 4-chain antibody unit is a heterotetrameric glycoprotein composed of two identical light (L) chains and two identical heavy (H) chains. In the case of IgGs, the 4-chain unit is generally about 150,000 daltons. Each L chain is linked to a H chain by one covalent disulfide bond, while the two H chains are linked to each other by one or more disulfide bonds depending on the H chain isotype. Each H and L chain also has regularly spaced intrachain disulfide bridges. Each H chain has at the N-terminus, a variable domain (VH) followed by three constant domains (CH) for each of the α and γ chains and four CH domains for µ and ε isotypes. Each L chain has at the N-terminus, a variable domain (VL) followed by a constant domain (CL) at its other end. The VL is aligned with the VH and the CL is aligned with the first constant domain of the heavy chain (CH1). Particular amino acid residues are believed to form an interface between the light chain and heavy chain variable domains. The pairing of a VH and VL together forms a single antigen-binding site. For the structure and properties of the different classes of antibodies, see, e.g., Basic and Clinical Immunology, 8th edition, Daniel P. Stites, Abba I. Terr and Tristram G. Parslow (eds.), Appleton & Lange, Norwalk, Conn., 1994, page 71 and Chapter 6.

The term "variable region" or "variable domain" refers to a portion of the light or heavy chains of an antibody that is generally located at the amino-terminal of the light or heavy chain and has a length of about 120 to 130 amino acids in the heavy chain and about 100 to 110 amino acids in the light chain, and are used in the binding and specificity of each particular antibody for its particular antigen. The variable region of the heavy chain may be referred to as "VH." The variable region of the light chain may be referred to as "VL." The term "variable" refers to the fact that certain segments of the variable regions differ extensively in sequence among antibodies. The V region mediates antigen binding and defines specificity of a particular antibody for its particular antigen. However, the variability is not evenly distributed across the 110-amino acid span of the variable regions. Instead, the V regions consist of less variable (e.g., relatively invariant) stretches called framework regions (FRs) of about 15-30 amino acids separated by shorter regions of greater variability (e.g., extreme variability) called "hypervariable regions" that are each about 9-12 amino acids long. The variable regions of heavy and light chains each comprise four FRs, largely adopting a β sheet configuration, connected by three hypervariable regions, which form loops connecting, and in some cases forming part of, the β sheet structure. The hypervariable regions in each chain are held together in close proximity by the FRs and, with the hypervariable regions from the other chain, contribute to the formation of the antigen-binding site of antibodies (see, e.g., Kabat et al., Sequences of Proteins of Immunological Interest, 5th Ed. Public Health Service, National Institutes of Health, Bethesda, Md., 1991)). The constant regions are not involved directly in binding an antibody to an antigen, but exhibit various effector functions, such as participation of the antibody in antibody dependent cellular cytotoxicity (ADCC) and complement dependent cytotoxicity (CDC). The variable regions differ extensively in sequence between different antibodies. The variability in sequence is concentrated in the CDRs while the less variable portions in the variable region are referred to as framework regions (FR). The CDRs of the light and heavy chains are primarily responsible for the interaction of the antibody with antigen. In specific embodiments, the variable region is a human variable region.

The term "variable region residue numbering as in Kabat" or "amino acid position numbering as in Kabat", and variations thereof, refers to the numbering system used for heavy chain variable regions or light chain variable regions of the compilation of antibodies in Kabat et al., Sequences of Proteins of Immunological Interest, 5th Ed. Public Health Service, National Institutes of Health, Bethesda, Md. (1991). Using this numbering system, the actual linear amino acid sequence may contain fewer or additional amino acids corresponding to a shortening of, or insertion into, a FR or CDR of the variable domain. For example, a heavy chain variable domain may include a single amino acid insert (residue 52a according to Kabat) after residue 52 of H2 and inserted residues (e.g., residues 82a, 82b, and 82c, etc, according to Kabat) after heavy chain FR residue 82. The Kabat numbering of residues may be determined for a given antibody by alignment at regions of homology of the sequence of the antibody with a "standard" Kabat numbered sequence. The Kabat numbering system is generally used when referring to a residue in the variable domain (approximately residues 1-107 of the light chain and residues 1-113 of the heavy chain) (e.g., Kabat et al., Sequences of Immunological Interest. 5th Ed. Public Health Service, National Institutes of Health, Bethesda, Md. (1991)). The "EU numbering system" or "EU index" is generally used when referring to a residue in an immunoglobulin heavy chain constant region (e.g., the EU index reported in Kabat et al., supra). The "EU index as in Kabat" refers to the residue numbering of the human IgG 1 EU antibody. Other numbering systems have been described, including, for example, by AbM, Chothia, Contact, IMGT and AHon. Various numbering systems are illustrated in Tables 1-24.

An "intact" antibody is one comprising an antigen-binding site as well as a light chain constant region CL and at least heavy chain constant regions, CH1, CH2 and CH3. The constant regions may include human constant regions or amino acid sequence variants thereof. Preferably, an intact antibody has one or more effector functions.

"Antibody fragments" comprise a portion of an intact antibody, preferably the antigen binding or variable region of the intact antibody. Examples of antibody fragments include, without limitation, Fab, Fab', F(ab')2, and Fv fragments; diabodies and di-diabodies (see, e.g., Holliger, P. et al., (1993) Proc. Natl. Acad. Sci. 90:6444-8; Lu, D. et al., (2005) J. Biol. Chem. 280:19665-72; Hudson et al., Nat. Med. 9:129-134 (2003); WO 93/11161; and U.S. Pat. Nos. 5,837,242 and 6,492,123); single-chain antibody molecules (see, e.g., U.S. Pat. Nos. 4,946,778; 5,260,203; 5,482,858 and 5,476,786); dual variable domain antibodies (see, e.g., U.S. Pat. No. 7,612,181); single variable domain antibodies (SdAbs) (see, e.g., Woolven et al., Immunogenetics 50: 98-101, 1999; Streltsov et al., Proc Natl Acad Sci USA. 101:12444-12449, 2004); and multispecific antibodies formed from antibody fragments.

A "functional fragment" or "binding fragment" or "antigen binding fragment" of a therapeutic antibody will exhibit at least one if not some or all of the biological functions attributed to the intact antibody, the function comprising at least binding to the target antigen, (e.g., a GFRAL binding fragment or fragment that binds to GFRAL).

The term "fusion protein" as used herein refers to a polypeptide that comprises an amino acid sequence of an antibody and an amino acid sequence of a heterologous polypeptide or protein (e.g., a polypeptide or protein not normally a part of the antibody (e.g., a non-anti-GFRAL antigen binding antibody)). The term "fusion" when used in relation to GFRAL or to an anti-GFRAL antibody refers to the joining of a peptide or polypeptide, or fragment, variant and/or derivative thereof, with a heterologous peptide or polypeptide. In certain embodiments, the fusion protein retains the biological activity of the GFRAL or anti-GFRAL antibody. In certain embodiments, the fusion protein comprises a GFRAL antibody VH region, VL region, VH CDR (one, two or three VH CDRs), and/or VL CDR (one, two or three VL CDRs), wherein the fusion protein binds to a GFRAL epitope, a GFRAL fragment and/or a GFRAL polypeptide.

The term "heavy chain" when used in reference to an antibody refers to a polypeptide chain of about 50-70 kDa, wherein the amino-terminal portion includes a variable region of about 120 to 130 or more amino acids and a carboxy-terminal portion that includes a constant region (e.g., CH1, CH2, CH3, CH4). The constant region can be one of five distinct types, (e.g., isotypes) referred to as alpha (α), delta (δ), epsilon (ε), gamma (γ) and mu (μ), based on the amino acid sequence of the heavy chain constant regions. The distinct heavy chains differ in size: α, δ and γ contain approximately 450 amino acids, while μ and ε contain approximately 550 amino acids. When combined with a light chain, these distinct types of heavy chains give rise to five well known classes (e.g., isotypes) of antibodies, IgA, IgD, IgE, IgG and IgM, respectively, including four subclasses of IgG, namely IgG1, IgG2, IgG3 and IgG4. A heavy chain can be a human heavy chain.

The term "light chain" when used in reference to an antibody refers to a polypeptide chain of about 25 kDa, wherein the amino-terminal portion includes a variable region of about 100 to about 110 or more amino acids and a carboxy-terminal portion that includes a constant region. The approximate length of a light chain is 211 to 217 amino acids. There are two distinct types, referred to as kappa (κ) of lambda (λ) based on the amino acid sequence of the constant domains. Light chain amino acid sequences are well known in the art. A light chain can be a human light chain.

The term "effective amount" as used herein refers to the amount of a therapy (e.g., an anti-GFRAL antibody or pharmaceutical composition provided herein; see, e.g., antibodies comprising CDR, VH, and/or VL sequences as shown in Tables 1-24) which is sufficient to reduce the severity and/or frequency of symptoms, eliminate the symptoms and/or underlying cause, prevent the occurrence of symptoms and/or their underlying cause, and/or improve or remediate the damage that results from or is associated with a GDF15-mediated disease, disorder, or condition, including, for example, involuntary body weight loss, a glucose metabolism disorder or a body weight disorder. This term also encompasses an amount necessary for the reduction or amelioration of the advancement or progression of a given GDF15-mediated disease, disorder or condition, reduction or amelioration of the recurrence, development or onset of a GDF15-mediated disease, disorder or condition, and/or to improve or enhance the prophylactic or therapeutic effect(s) of another therapy (e.g., a therapy other than anti-GFRAL antibody provided herein). In some embodiments, the effective amount is administered in one or more doses, including intermittent doses, wherein one ore more doses are given in a treatment period followed by a resting period when an antibody is not administered (e.g., one cycle of treatment period and rest period can be followed with additional cycles, with one or more treatment periods followed by one or more resting periods). In some embodiments, the effective amount of an antibody provided herein is from about 0.1 mg/kg (mg of antibody per kg weight of the subject) to about 100 mg/kg. In certain embodiments, an effective amount of an antibody provided therein is about 0.1 mg/kg, about 0.5 mg/kg, about 1 mg/kg, 3 mg/kg, 5 mg/kg, about 10 mg/kg, about 15 mg/kg, about 20 mg/kg, about 25 mg/kg, about 30 mg/kg, about 35 mg/kg, about 40 mg/kg, about 45 mg/kg, about 50 mg/kg, about 60 mg/kg, about 70 mg/kg, about 80 mg/kg, about 90 mg/kg, or about 100 mg/kg (or a range therein). In some embodiments, effective amount as used herein also refers to the amount of an antibody provided herein to achieve a specified result (e.g., mimic or modulate an in vitro or an in vivo biological effect induced by the binding of: (i) GFRAL; (ii) GDF15 and GFRAL; or (iii) GDF15, GFRAL, and RET). For example, an effective amount includes an amount (e.g., in one or more doses) of an anti-GFRAL antibody as described herein effective to: (i) increase body weight; (ii) maintain body weight; (iii) reduce body weight loss; (iv) increase body mass (e.g., lean mass or fat mass); (v) maintain body mass (e.g., lean mass or fat mass); or (vi) reduce loss of body mass (e.g., lean mass or fat mass).

The term "host cell" as used herein refers to a particular subject cell that may be transfected with a nucleic acid molecule and the progeny or potential progeny of such a cell. Progeny of such a cell may not be identical to the parent cell transfected with the nucleic acid molecule due to mutations or environmental influences that may occur in succeeding generations or integration of the nucleic acid molecule into the host cell genome.

The term "immunomodulatory agent" and variations thereof including, but not limited to, immunomodulatory agents, as used herein refer to an agent that modulates a host's immune system. In certain embodiments, an immunomodulatory agent used in the combination therapies provided herein does not include an anti-GFRAL antibody or antigen-binding fragment. Immunomodulatory agents include, but are not limited to, small molecules, peptides, polypeptides, proteins, fusion proteins, antibodies, inorganic molecules, mimetic agents, and organic molecules. The term "small molecule" and analogous terms include, but are not limited to, peptides, peptidomimetics, amino acids, amino acid analogues, polynucleotides, polynucleotide analogues, nucleotides, nucleotide analogues, organic or inorganic compounds (i.e., including heterorganic and/or ganometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, and salts, esters, and other pharmaceutically acceptable forms of such compounds. In some embodiments, an immunomodulatory agent is an immunostimulatory agent. In some embodiments, an immunomodulatory agent is an immunosuppressant agent. In some embodiments, immunomodulatory agents are agents (e.g., antibodies) that modulate (e.g., inhibit or stimulate) proteins known as immune checkpoint molecules (e.g., co-inhibitory or co-stimulatory), for example, C10orf54, CD86, CD80, PDL-1, PDL-2, CTLA-4, PD1, LAG3, BTNL2, B7-H3, B7-H4, a butyrophilin, CD48, CD244, TIM-3, CD200R, CD200, CD160, BTLA, HVEM, LAIR1, TIM1, Galectin 9, TIM3, CD48, 2B4, CD155, CD112, CD113 and TIGIT (e.g., co-inhibitory), and/or CD154, TNFRSF25, GITR, 4-1BB, OX40, CD27, TMIGD2, ICOS, CD28, CD40, TL1A, GITRL, 41BBL, OX40L, CD70, HHLA2, ICOSL, a cytokine, LIGHT, HVEM, CD30, CD30L, B7-H2, CD80, CD86, CD40L, TIM4, TIM1, SLAM, CD48, CD58, CD155, CD112, DR3, GITR, CD2, and CD226 (e.g., co-stimulatory).

The term "monoclonal antibody" as used herein refers to an antibody obtained from a population of substantially homogeneous antibodies, e.g., the individual antibodies comprising the population are identical except for possible naturally occurring mutations that may be present in minor amounts, and each monoclonal antibody will typically recognize a single epitope on the antigen. In specific embodiments, a "monoclonal antibody," as used herein, is an antibody produced by a single hybridoma or other cell, wherein the antibody binds to only a GFRAL epitope as determined, for example, by ELISA or other antigen-binding or competitive binding assay known in the art. The term "monoclonal" is not limited to any particular method for making the antibody. For example, the monoclonal antibodies useful in the present disclosure may be prepared by the hybridoma methodology first described by Kohler et al., Nature, 256:495 (1975), or may be made using recombinant DNA methods in bacterial, eukaryotic animal or plant cells (see, e.g., U.S. Pat. No. 4,816,567). The "monoclonal antibodies" may also be isolated from phage antibody libraries using the techniques described in Clackson et al., Nature, 352:624-628 (1991) and Marks et al., J. Mol. Biol., 222: 581-597 (1991), for example. Other methods for the preparation of clonal cell lines and of monoclonal antibodies expressed thereby are well known in the art (see, for example, Chapter 11 in: Short Protocols in Molecular Biology, (2002) 5th Ed., Ausubel et al., eds., John Wiley and Sons, New York). Exemplary methods of producing monoclonal antibodies are provided in the Examples herein.

The term "native" when used in connection with biological materials such as nucleic acid molecules, polypeptides, host cells, and the like, refers to those which are found in nature and not manipulated, modified, and/or changed (e.g., isolated, purified, selected) by a human being.

The antibodies provided herein can include "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (see, e.g., U.S. Pat. No. 4,816,567; and Morrison et al., Proc. Natl. Acad. Sci. USA, 81:6851-6855 (1984)).

"Humanized" forms of nonhuman (e.g., murine) antibodies are chimeric antibodies that include human immunoglobulins (e.g., recipient antibody) in which the native CDR residues are replaced by residues from the corresponding CDR of a nonhuman species (e.g., donor antibody) such as mouse, rat, rabbit or nonhuman primate having the desired specificity, affinity, and capacity. In some instances, one or more FR region residues of the human immunoglobulin are replaced by corresponding nonhuman residues. Furthermore, humanized antibodies can comprise residues that are not found in the recipient antibody or in the donor antibody. These modifications are made to further refine antibody performance. A humanized antibody heavy or light chain can comprise substantially all of at least one or more variable regions, in which all or substantially all of the CDRs correspond to those of a nonhuman immunoglobulin and all or substantially all of the FRs are those of a human immunoglobulin sequence. In certain embodiments, the humanized antibody will comprise at least a portion of an immunoglobulin constant region (Fc), typically that of a human immunoglobulin. For further details, see, Jones et al., Nature, 321:522-525 (1986); Riechmann et al., Nature, 332:323-329 (1988); and Presta, Curr. Op. Struct. Biol., 2:593-596 (1992); Carter et al., Proc. Natl. Acd. Sci. USA 89:4285-4289 (1992); and U.S. Pat. No. 6,800,738 (issued Oct. 5, 2004), U.S. Pat. No. 6,719,971 (issued Sep. 27, 2005), U.S. Pat. No. 6,639,055 (issued Oct. 28, 2003), U.S. Pat. No. 6,407,213 (issued Jun. 18, 2002), and U.S. Pat. No. 6,054,297 (issued Apr. 25, 2000).

A "human antibody" is one which possesses an amino acid sequence which corresponds to that of an antibody produced by a human and/or has been made using any of the techniques for making human antibodies as disclosed herein. This definition of a human antibody specifically excludes a humanized antibody comprising non-human antigen-binding residues. Human antibodies can be produced using various techniques known in the art, including phage-display libraries (Hoogenboom and Winter, J. Mol. Biol., 227:381 (1991); Marks et al., J. Mol. Biol., 222:581 (1991)

and yeast display libraries (Chao et al., Nature Protocols 1: 755-768 (2006)). Also available for the preparation of human monoclonal antibodies are methods described in Cole et al., Monoclonal Antibodies and Cancer Therapy, Alan R. Liss, p. 77 (1985); Boerner et al., J. Immunol., 147(1):86-95 (1991). See also van Dijk and van de Winkel, Curr. Opin. Pharmacol., 5: 368-74 (2001). Human antibodies can be prepared by administering the antigen to a transgenic animal that has been modified to produce such antibodies in response to antigenic challenge, but whose endogenous loci have been disabled, e.g., mice (see, e.g., Jakobovits, A., Curr. Opin. Biotechnol. 1995, 6(5):561-6; Brüggemann and Taussing, Curr. Opin. Biotechnol. 1997, 8(4):455-8; and U.S. Pat. Nos. 6,075,181 and 6,150,584 regarding XENOMOUSE™ technology). See also, for example, Li et al., Proc. Natl. Acad. Sci. USA, 103:3557-3562 (2006) regarding human antibodies generated via a human B-cell hybridoma technology.

A "CDR" refers to one of three hypervariable regions (H1, H2 or H3) within the non-framework region of the immunoglobulin (Ig or antibody) VH β-sheet framework, or one of three hypervariable regions (L1, L2 or L3) within the non-framework region of the antibody VL β-sheet framework. Accordingly, CDRs are variable region sequences interspersed within the framework region sequences. CDR regions are well known to those skilled in the art and have been defined by, for example, Kabat as the regions of most hypervariability within the antibody variable (V) domains (Kabat et al., J. Biol. Chem. 252:6609-6616 (1977); Kabat, Adv. Prot. Chem. 32:1-75 (1978)). CDR region sequences also have been defined structurally by Chothia as those residues that are not part of the conserved β-sheet framework, and thus are able to adapt different conformations (Chothia and Lesk, J. Mol. Biol. 196:901-917 (1987)). Both terminologies are well recognized in the art. CDR region sequences have also been defined by AbM, Contact and IMGT. CDR region sequences are illustrated in Tables 1-24. The positions of CDRs within a canonical antibody variable region have been determined by comparison of numerous structures (Al-Lazikani et al., J. Mol. Biol. 273:927-948 (1997); Morea et al., Methods 20:267-279 (2000)). Because the number of residues within a hypervariable region varies in different antibodies, additional residues relative to the canonical positions are conventionally numbered with a, b, c and so forth next to the residue number in the canonical variable region numbering scheme (Al-Lazikani et al., supra (1997)). Such nomenclature is similarly well known to those skilled in the art.

The term "hypervariable region", "HVR", or "HV", when used herein refers to the regions of an antibody variable region that are hypervariable in sequence and/or form structurally defined loops. Generally, antibodies comprise six hypervariable regions; three in the VH (H1, H2, H3), and three in the VL (L1, L2, L3). A number of hypervariable region delineations are in use and are encompassed herein. The Kabat Complementarity Determining Regions (CDRs) are based on sequence variability and are the most commonly used (see, e.g., Kabat et al., Sequences of Proteins of Immunological Interest, 5th Ed. Public Health Service, National Institutes of Health, Bethesda, Md. (1991)). Chothia refers instead to the location of the structural loops (see, e.g., Chothia and Lesk, J. Mol. Biol. 196:901-917 (1987)). The end of the Chothia CDR-H1 loop when numbered using the Kabat numbering convention varies between H32 and H34 depending on the length of the loop (this is because the Kabat numbering scheme places the insertions at H35A and H35B; if neither 35A nor 35B is present, the loop ends at 32; if only 35A is present, the loop ends at 33; if both 35A and 35B are present, the loop ends at 34). The AbM hypervariable regions represent a compromise between the Kabat CDRs and Chothia structural loops, and are used by Oxford Molecular's AbM antibody modeling software (see, e.g., Martin, in Antibody Engineering, Vol. 2, Chapter 3, Springer Verlag). The "contact" hypervariable regions are based on an analysis of the available complex crystal structures. The residues from each of these hypervariable regions or CDRs are noted below.

Recently, a universal numbering system has been developed and widely adopted, ImMunoGeneTics (IMGT) Information System® (Lafranc et al., Dev. Comp. Immunol. 27(1):55-77 (2003)). IMGT is an integrated information system specializing in immunoglobulins (IG), T cell receptors (TR) and major histocompatibility complex (MHC) of human and other vertebrates. Herein, the CDRs are referred to in terms of both the amino acid sequence and the location within the light or heavy chain. As the "location" of the CDRs within the structure of the immunoglobulin variable domain is conserved between species and present in structures called loops, by using numbering systems that align variable domain sequences according to structural features, CDR and framework residues and are readily identified. This information can be used in grafting and replacement of CDR residues from immunoglobulins of one species into an acceptor framework from, typically, a human antibody. An additional numbering system (AHon) has been developed by Honegger and Plückthun, J. Mol. Biol. 309: 657-670 (2001). Correspondence between the numbering system, including, for example, the Kabat numbering and the IMGT unique numbering system, is well known to one skilled in the art (see, e.g., Kabat, supra; Chothia and Lesk, supra; Martin, supra; Lefranc et al., supra) and is also illustrated in Tables 1-24. An Exemplary system, shown herein, combines Kabat and Chothia.

| | Exemplary | IMGT | Kabat | AbM | Chothia | Contact |
|---|---|---|---|---|---|---|
| $V_H$ CDR1 | 26-35 | 27-38 | 31-35 | 26-35 | 26-32 | 30-35 |
| $V_H$ CDR2 | 50-65 | 56-65 | 50-65 | 50-58 | 53-55 | 47-58 |
| $V_H$ CDR3 | 95-102 | 105-117 | 95-102 | 95-102 | 96-101 | 93-101 |
| $V_L$ CDR1 | 24-34 | 27-38 | 24-34 | 24-34 | 26-32 | 30-36 |
| $V_L$ CDR2 | 50-56 | 56-65 | 50-56 | 50-56 | 50-52 | 46-55 |
| $V_L$ CDR3 | 89-97 | 105-117 | 89-97 | 89-97 | 91-96 | 89-96 |

Hypervariable regions may comprise "extended hypervariable regions" as follows: 24-36 or 24-34 (L1), 46-56 or 50-56 (L2) and 89-97 or 89-96 (L3) in the VL and 26-35 or 26-35A (H1), 50-65 or 49-65 (H2) and 93-102, 94-102, or 95-102 (H3) in the VH. As used herein, the terms "HVR" and "CDR" are used interchangeably.

The term "constant region" or "constant domain" refers to a carboxy terminal portion of the light and heavy chain which is not directly involved in binding of the antibody to antigen but exhibits various effector function, such as interaction with the Fc receptor. The terms refer to the portion of an immunoglobulin molecule having a more conserved amino acid sequence relative to the other portion of the immunoglobulin, the variable region, which contains the antigen binding site. The constant region may contain the CH1, CH2 and CH3 regions of the heavy chain and the CL region of the light chain.

The term "framework" or "FR" residues are those variable region residues flanking the CDRs. FR residues are present, for example, in chimeric, humanized, human, domain antibodies, diabodies, linear antibodies, and bispecific antibodies. FR residues are those variable domain residues other than the hypervariable region residues or CDR residues.

An "affinity matured" antibody is one with one or more alterations (e.g., amino acid sequence variations, including changes, additions and/or deletions) in one or more HVRs thereof which result in an improvement in the affinity of the antibody for antigen, compared to a parent antibody which does not possess those alteration(s). Preferred affinity matured antibodies will have nanomolar or even picomolar affinities for the target antigen. Affinity matured antibodies are produced by procedures known in the art. For review, see Hudson and Souriau, Nature Medicine 9:129-134 (2003); Hoogenboom, Nature Biotechnol. 23: 1105-1116 (2005); Quiroz and Sinclair, Revista Ingeneria Biomedia 4: 39-51 (2010).

A "blocking" antibody or an "antagonist" antibody is one which inhibits or reduces biological activity of the antigen it binds (e.g., GFRAL, as described herein). For example, blocking antibodies or antagonist antibodies may substantially or completely inhibit the biological activity of the antigen (e.g., GFRAL, as described herein).

An "agonist antibody" is an antibody that triggers a response, e.g., one that mimics at least one of the functional activities of a polypeptide of interest. An agonist antibody includes an antibody that is a ligand mimetic, for example, wherein a ligand binds to a cell surface receptor and the binding induces cell signaling or activities via an intercellular cell signaling pathway and wherein the antibody induces a similar cell signaling or activation.

An "antagonist" of GFRAL refers to a molecule (e.g., antibody) that is capable of detectably inhibiting or otherwise decreasing one or more of the biological activities of GFRAL, such as in a cell expressing GFRAL. In some embodiments, an antagonist of GFRAL (e.g., an agonistic antibody as described herein) may, for example, act by detectably inhibiting or otherwise decreasing the activation and/or cell signaling pathways of a cell expressing a GFRAL, thereby detectably decreasing a GFRAL-mediated biological activity of the cell relative to the GFRAL-mediated biological activity in the absence of antagonist. In some embodiments the antibodies provided herein are antagonistic anti-GFRAL antibodies, including antibodies that inhibit signaling of a complex comprising GFRAL, GDF15 and/or RET. The inhibition or decrease caused by a GFRAL antagonist need not be complete as long as it is detectable using an assay. For example, a cell-based assay described in the Examples below can be used to analyze a biological activity of GFRAL.

"Binding affinity" generally refers to the strength of the sum total of noncovalent interactions between a single binding site of a molecule (e.g., a binding protein such as an antibody) and its binding partner (e.g., an antigen). Unless indicated otherwise, as used herein, "binding affinity" refers to intrinsic binding affinity which reflects a 1:1 interaction between members of a binding pair (e.g., antibody and antigen). The affinity of a binding molecule X for its binding partner Y can generally be represented by the dissociation constant ($K_D$). Affinity can be measured by common methods known in the art, including those described herein. Low-affinity antibodies generally bind antigen slowly and tend to dissociate readily, whereas high-affinity antibodies generally bind antigen faster and tend to remain bound longer. A variety of methods of measuring binding affinity are known in the art, any of which can be used for purposes of the present disclosure. Specific illustrative embodiments include the following. In one embodiment, the "$K_D$" or "$K_D$ value" may be measured by assays known in the art, for example by a binding assay. The $K_D$ may be measured in a radiolabeled antigen binding assay (RIA), for example, performed with the Fab version of an antibody of interest and its antigen (Chen, et al., (1999) J. Mol Biol 293:865-881). The $K_D$ or $K_D$ value may also be measured by using surface plasmon resonance assays by Biacore, using, for example, a BIAcore™-2000 or a BIAcore™-3000 BIAcore, Inc., Piscataway, N.J.), or by biolayer interferometry using, for example, the OctetQK384 sytem (ForteBio, Menlo Park, Calif.). An "on-rate" or "rate of association" or "association rate" or "kon" may can also be determined with the same surface plasmon resonance or biolayer interferometry techniques described above using, for example, a BIAcore™-2000 or a BIAcore™-3000 (BIAcore, Inc., Piscataway, N.J.), or the OctetQK384 sytem (ForteBio, Menlo Park, Calif.).

The phrase "substantially similar" or "substantially the same" denotes a sufficiently high degree of similarity between two numeric values (e.g., one associated with an antibody of the present disclosure and the other associated with a reference antibody) such that one of skill in the art would consider the difference between the two values to be of little or no biological and/or statistical significance within the context of the biological characteristic measured by the values (e.g., $K_D$ values). For example, the difference between the two values may be less than about 50%, less than about 40%, less than about 30%, less than about 20%, less than about 10%, less than about 5%, as a function of the value for the reference antibody.

The phrase "substantially reduced," or "substantially different", as used herein, denotes a sufficiently high degree of difference between two numeric values (e.g., one associated with an antibody of the present disclosure and the other associated with a reference antibody) such that one of skill in the art would consider the difference between the two values to be of statistical significance within the context of the biological characteristic measured by the values. For example, the difference between said two values may be preferably greater than about 10%, greater than about 20%, greater than about 30%, greater than about 40%, greater than about 50% as a function of the value for the reference antibody.

Antibody "effector functions" refer to those biological activities attributable to the Fc region (e.g., a native sequence Fc region or amino acid sequence variant Fc region) of an antibody, and vary with the antibody isotype. Examples of antibody effector functions include: C1q binding and complement dependent cytotoxicity; Fc receptor binding; antibody-dependent cell-mediated cytotoxicity (ADCC); phagocytosis; down regulation of cell surface receptors (e.g., B cell receptor); and B cell activation.

The term "Fc region" herein is used to define a C-terminal region of an immunoglobulin heavy chain, including, for example, native sequence Fc regions, recombinant Fc regions, and variant Fc regions. Although the boundaries of the Fc region of an immunoglobulin heavy chain might vary, the human IgG heavy chain Fc region is often defined to stretch from an amino acid residue at position Cys226, or from Pro230, to the carboxyl-terminus thereof. The C-terminal lysine (residue 447 according to the EU numbering system) of the Fc region may be removed, for example, during production or purification of the antibody, or by recombinantly engineering the nucleic acid encoding a heavy chain of the antibody. Accordingly, a composition of intact antibodies may comprise antibody populations with all K447 residues removed, antibody populations with no K447 residues removed, and antibody populations having a mixture of antibodies with and without the K447 residue.

A "functional Fc region" possesses an "effector function" of a native sequence Fc region. Exemplary "effector functions" include C1q binding; complement dependent cytotoxicity (CDC); Fc receptor binding; antibody-dependent cell-mediated cytotoxicity (ADCC); phagocytosis; down regulation of cell surface receptors (e.g., B cell receptor; BCR), etc. Such effector functions generally require the Fc region to be combined with a binding region or binding domain (e.g., an antibody variable region or domain) and can be assessed, including using various assays as disclosed herein and/or as known in the art.

A "native sequence Fc region" comprises an amino acid sequence identical to the amino acid sequence of an Fc region found in nature, and not manipulated, modified, and/or changed (e.g., isolated, purified, selected, including or combining with other sequences such as variable region sequences) by a human. Native sequence human Fc regions include a native sequence human IgG1 Fc region (non-A and A allotypes); native sequence human IgG2 Fc region; native sequence human IgG3 Fc region; and native sequence human IgG4 Fc region as well as naturally occurring variants thereof.

A "variant Fc region" comprises an amino acid sequence which differs from that of a native sequence Fc region by virtue of at least one amino acid modification, (e.g., substituting, addition, or deletion) preferably one or more amino acid substitution(s). Preferably, the variant Fc region has at least one amino acid substitution compared to a native sequence Fc region or to the Fc region of a parent polypeptide, for example, from about one to about ten amino acid substitutions, and preferably from about one to about five amino acid substitutions in a native sequence Fc region or in the Fc region of the parent polypeptide. The variant Fc region herein will preferably possess at least about 80% homology with a native sequence Fc region and/or with an Fc region of a parent polypeptide, and more preferably at least about 90% homology therewith, for example, at least about 95% homology therewith. For example, a variant with two amino acid changes to alanine at two positions in the human IgG1 Fc sequence are shown bolded in the amino acid sequence provided below:

(SEQ ID NO: 2001)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

KSCDKTHTCPPCPAPALAGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK

For example, a variant with two amino acid changes to alanine at two positions in a truncated human IgG1 Fc sequence, in which the C-terminal lysine residue is absent (IgG1ΔK Fc), are shown bolded in the amino acid sequence provided below:

(SEQ ID NO: 2002)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

KSCDKTHTCPPCPAPALAGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPG

For example, a truncated variant of the human IgG1 Fc sequence, in which the C-terminal lysine residue is absent (IgG1ΔK Fc) is shown in the amino acid sequence provided below:

(SEQ ID NO: 2003)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPG

For example, a variant with an amino acid change to proline at a position in the human IgG4 Fc sequence is shown bolded in the amino acid sequence provided below:

(SEQ ID NO: 2004)
ASTKGPSVFPLAPCSRSTSESTAALGCLVKDYFPEPVTVSWNSGALTSGV

HTFPAVLQSSGLYSLSSVVTVPSSSLGTKTYTCNVDHKPSNTKVDKRVES

KYGPPCPPCPAPEFLGGPSVFLFPPKPKDTLMISRTPEVTCVVVDVSQED

PEVQFNWYVDGVEVHNAKTKPREEQFNSTYRVVSVLTVLHQDWLNGKEYK

CKVSNKGLPSSIEKTISKAKGQPREPQVYTLPPSQEEMTKNQVSLTCLVK

GFYPSDIAVEWESNGQPENNYKTTPPVLDSDGSFFLYSRLTVDKSRWQEG

NVFSCSVMHEALHNHYTQKSLSLSLGK

For example, a variant with an amino acid change to proline at a position in a human IgG4 Fc sequence, in which the C-terminal lysine is absent (IgG4 ΔK Fc), is shown bolded in the amino acid sequence provided below:

(SEQ ID NO: 2005)
ASTKGPSVFPLAPCSRSTSESTAALGCLVKDYFPEPVTVSWNSGALTSGV

HTFPAVLQSSGLYSLSSVVTVPSSSLGTKTYTCNVDHKPSNTKVDKRVES

KYGPPCPPCPAPEFLGGPSVFLFPPKPKDTLMISRTPEVTCVVVDVSQED

PEVQFNWYVDGVEVHNAKTKPREEQFNSTYRVVSVLTVLHQDWLNGKEYK

CKVSNKGLPSSIEKTISKAKGQPREPQVYTLPPSQEEMTKNQVSLTCLVK

GFYPSDIAVEWESNGQPENNYKTTPPVLDSDGSFFLYSRLTVDKSRWQEG

NVFSCSVMHEALHNHYTQKSLSLSLG

For example, a variant with an amino acid change to Glutamine at a position in the human IgG1 Fc sequence is shown bolded in the amino acid sequence provided below:

```
                                        (SEQ ID NO: 2006)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPELLGGPSVFLFPPKPKDTLMISRTPEVTCVVV

DVSHEDPEVKFNWYVDGVEVHNAKTKPREEQYQSTYRVVSVLTVLHQ

DWLNGKEYKCKVSNKALPAPIEKTISKAKGQPREPQVYTLPPSREEMTK

NQVSLTCLVKGFYPSDIAVEWESNGQPENNYKTTPPVLDSDGSFFLYSK

LTVDKSRWQQGNVFSCSVMHEALHNHYTQKSLSLSPGK
```

Any of the VH domains of Tables 1-24 and of FIGS. 4A, 5A, 5C, 5E, 6A, 7A, 8A, 9A, and 10A may be combined with a variant Fc region described herein. Exemplary heavy chain constructs comprising a variant Fc region may include the following constructs designated as shown below; the variable region sequence is bolded with CDR sequences underlined:

```
3P10 Fab Hc:
                                        (SEQ ID NO: 1824)
QIQLVQSGPELKKPGETVKISCKASGYTFTDYGVIWVKQAPGKALKWM

GWINTYTGEPTYADDLKGRFAFSLETSASSASLQINNLKNEDTATYFCA

RRYGPEDIDYWGQGTTLTVSSASTKGPSVFPLAPSSKSTSGGTAALGCL

VKDYFPEPVTVSWNSGALTSGVHTFPAVLQSSGLYSLSSVVTVPSSSLG

TQTYICNVNHKPSNTKVDKKVEPKSCDEVD

25M22 Fab Hc:
                                        (SEQ ID NO: 1826)
QVQLQQSGPDLVKPGASVKISCKASGYTFTSYWVNWMKQRPGKGLE

WIGRIYPGDGDTNYNGKFKGKATLTADKSSSTAYMQLSSLTSEDSAVY

FCARAYLLRLRRTGYYAMDYWGQGTSVTVSSASTKGPSVFPLAPSSKS

TSGGTAALGCLVKDYFPEPVTVSWNSGALTSGVHTFPAVLQSSGLYSLS

SVVTVPSSSLGTQTYICNVNHKPSNTKVDKKVEPKSCDEVD

8D8 Fab Hc:
                                        (SEQ ID NO: 1828)
QVQLKESGPGLVAPSQSLSITCTVSGFSLSRYSVHWVRQPPGKGLEW

LGMIWGFGSTDYNSALKSRLSITKDNSKSQFFLKMNSLQTDDTAMYYC

ARIHTTAGSYWGQGTLVTVSAASTKGPSVFPLAPSSKSTSGGTAALGCL

VKDYFPEPVTVSWNSGALTSGVHTFPAVLQSSGLYSLSSVVTVPSSSLG

TQTYICNVNHKPSNTKVDKKVEPKSCDEVDG

5F12 Fab Hc:
                                        (SEQ ID NO: 1830)
QVQLKQSGTELVRPGASVKLSCKASGYTFTDYYINWVKQRPGQGLEW

IARIYPGNGNTYHNEKFKGKATLTAEKSSSTAYMQLSSLTSEDSAVYFC

AREGLYYDYDRYFDYWGQGTALTVSSASTKGPSVFPLAPSSKSTSGGT

AALGCLVKDYFPEPVTVSWNSGALTSGVHTFPAVLQSSGLYSLSSVVTV

PSSSLGTQTYICNVNHKPSNTKVDKKVEPKSCDEVDG
```

A "light chain constant region" includes kappa and lambda constant regions. Any of the VL domains of Tables 1-24 and of FIGS. 4B, 5B, 5D, 5F, 6B, 7B, 8B, 9B, and 10B may be combined with a kappa or lambda constant region described herein.

An exemplary kappa constant region is provided below:

```
                                        (SEQ ID NO: 2007)
RTVAAPSVFIFPPSDEQLKSGTASVVCLLNNFYPREAKVQWKVDNALQS

GNSQESVTEQDSKDSTYSLSSTLTLSKADYEKHKVYACEVTHQGLSSPV

TKSFNRGEC
```

An exemplary lambda constant region is provided below:

```
                                        (SEQ ID NO: 2008)
GQPKAAPSVTLFPPSSEELQANKATLVCLISDFYPGAVTVAWKADSSPV

KAGVETTTPSKQSNNKYAASSYLSLTPEQWKSHRSYSCQVTHEGSTVE

KTVAPTECS
```

Exemplary light chain constructs comprising a constant region may include the following constructs designated as shown below; the variable region sequence is bolded with CDR sequences underlined:

```
3P10 Fab Lc:
                                        (SEQ ID NO: 1825)
DIVLTQSPVSLAVSLGQRATISCRASESVDNYGISFMSWFQQKPGQPP

KLLIYAASHQGSGVPARFSGSGSGTDFSLNIHPMEEDDSAMYFCLQSK

EVPWTFGGGTKLEIKRTVAAPSVFIFPPSDEQLKSGTASVVCLLNNFYP

REAKVQWKVDNALQSGNSQESVTEQDSKDSTYSLSSTLTLSKADYEKH

KVYACEVTHQGLSSPVTKSFNRGEC

25M22 Fab Lc:
                                        (SEQ ID NO: 1827)
DVVLTQTPLSLPVNIGDQASISCKSTKSLLNSDEFTYLDWYLQKPGQSP

QLLIFLVSNRFSGVPDRFSGSGSGTDFTLKISRVEAEDLGVYYCFQSNY

LPYTFGGGTKLEIKRTVAAPSVFIFPPSDEQLKSGTASVVCLLNNFYPRE

AKVQWKVDNALQSGNSQESVTEQDSKDSTYSLSSTLTLSKADYEKHKV

YACEVTHQGLSSPVTKSFNRGEC

8D8 Fab Lc:
                                        (SEQ ID NO: 1829)
DIVMTQSQKFMSTSIGDRVSVTCKASQNVGTNVAWYQQKPGQSPKAL

VYSTSYRYSGVPDRFTGSGSGTDFTLTISNVQSEDLAEYFCHQYNSYPL

TFGAGTKLELKRTVAAPSVFIFPPSDEQLKSGTASVVCLLNNFYPREAK

VQWKVDNALQSGNSQESVTEQDSKDSTYSLSSTLTLSKADYEKHKVYA

CEVTHQGLSSPVTKSFNRGEC

5F12 Fab Lc:
                                        (SEQ ID NO: 1831)
NIVLTQSPASLAVSLGQRATISCRASESVDTYGNSFMHWYQQKPGQPP

KLLIYLASNLESGVPARFSGSGSRTDFTLTIDPVEADDAATYYCHQNNE

DPPAFGGGTKLEIKRTVAAPSVFIFPPSDEQLKSGTASVVCLLNNFYPRE

AKVQWKVDNALQSGNSQESVTEQDSKDSTYSLSSTLTLSKADYEKHKV

YACEVTHQGLSSPVTKSFNRGEC
```

The term "variant" when used in relation to GFRAL or to an anti-GFRAL antibody may refer to a peptide or polypeptide comprising one or more (such as, for example, about 1 to about 25, about 1 to about 20, about 1 to about 15, about 1 to about 10, or about 1 to about 5) amino acid sequence substitutions, deletions, and/or additions as compared to a native or unmodified GFRAL sequence. For example, a GFRAL variant may result from one or more (such as, for example, about 1 to about 25, about 1 to about 20, about 1 to about 15, about 1 to about 10, or about 1 to about 5) changes to an amino acid sequence of a native GFRAL. Also by way of example, a variant of an anti-GFRAL antibody may result from one or more (such as, for example, about 1 to about 25, about 1 to about 20, about 1 to about 15, about 1 to about 10, or about 1 to about 5) changes to an amino acid sequence of a native or previously unmodified anti-GFRAL antibody. Variants may be naturally occurring, such as allelic or splice variants, or may be artificially constructed. Polypeptide variants may be prepared from the corresponding nucleic acid molecules encoding the variants. In some embodiments, the GFRAL variant or anti-GFRAL antibody variant at least retains GFRAL or anti-GFRAL antibody functional activity, respectively. In some embodiments, an anti-GFRAL antibody variant binds GFRAL and/or is antagonistic to GFRAL activity. In some embodiments, an anti-GFRAL antibody variant binds GFRAL and/or is agonistic to GFRAL activity. In some embodiments, the variant is encoded by a single nucleotide polymorphism (SNP) variant of a nucleic acid molecule that encodes GFRAL or anti-GFRAL antibody VH or VL regions or subregions, such as one or more CDRs.

The term "vector" refers to a substance that is used to carry or include a nucleic acid sequences, including for example, in order to introduce a nucleic acid sequence into a host cell. Vectors applicable for use include, for example, expression vectors, plasmids, phage vectors, viral vectors, episomes and artificial chromosomes, which can include selection sequences or markers operable for stable integration into a host cell's chromosome. Additionally, the vectors can include one or more selectable marker genes and appropriate expression control sequences. Selectable marker genes that can be included, for example, provide resistance to antibiotics or toxins, complement auxotrophic deficiencies, or supply critical nutrients not in the culture media. Expression control sequences can include constitutive and inducible promoters, transcription enhancers, transcription terminators, and the like which are well known in the art. When two or more nucleic acid molecules are to be co-expressed (e.g. both an antibody heavy and light chain or an antibody VH and VL) both nucleic acid molecules can be inserted, for example, into a single expression vector or in separate expression vectors. For single vector expression, the encoding nucleic acids can be operationally linked to one common expression control sequence or linked to different expression control sequences, such as one inducible promoter and one constitutive promoter. The introduction of nucleic acid molecules into a host cell can be confirmed using methods well known in the art. Such methods include, for example, nucleic acid analysis such as Northern blots or polymerase chain reaction (PCR) amplification of mRNA, or immunoblotting for expression of gene products, or other suitable analytical methods to test the expression of an introduced nucleic acid sequence or its corresponding gene product. It is understood by those skilled in the art that the nucleic acid molecules are expressed in a sufficient amount to produce a desired product (e.g. an anti-GFRAL antibody as described herein), and it is further understood that expression levels can be optimized to obtain sufficient expression using methods well known in the art.

"Antibody-dependent cell-mediated cytotoxicity" or "ADCC" refers to a form of cytotoxicity in which secreted Ig bound onto Fc receptors (FcRs) present on certain cytotoxic cells (e.g., Natural Killer (NK) cells, neutrophils, and macrophages) enable these cytotoxic effector cells to bind specifically to an antigen-bearing target cell and subsequently kill the target cell with cytotoxins. The antibodies "arm" the cytotoxic cells and are absolutely required for such killing. The primary cells for mediating ADCC, NK cells, express FcγRIII only, whereas monocytes express FcγRI, FcγRII and FcγRIII. FcR expression on hematopoietic cells is known (see, e.g., Table 3, page 464, Ravetch and Kinet, Annu. Rev. Immunol. 9:457-92 (1991)). To assess ADCC activity of a molecule of interest, an in vitro ADCC assay, (see, e.g., U.S. Pat. No. 5,500,362 or 5,821,337) may be performed. Useful effector cells for such assays include peripheral blood mononuclear cells (PBMC) and Natural Killer (NK) cells. Alternatively, or additionally, ADCC activity of the molecule of interest may be assessed in vivo, for example, in a animal model (see, e.g., Clynes et al. (USA) 95:652-656 (1998)). Antibodies with little or no ADCC activity may be selected for use.

"Fc receptor" or "FcR" describes a receptor that binds to the Fc region of an antibody. The preferred FcR is a native sequence human FcR. Moreover, a preferred FcR is one that binds an IgG antibody (e.g., a gamma receptor) and includes receptors of the FcγRI, FcγRII and FcγRIII subclasses, including allelic variants and alternatively spliced forms of these receptors. FcγRII receptors include FcγRIIA (an "activating receptor") and FcγRIIB (an "inhibiting receptor"), which have similar amino acid sequences that differ primarily in the cytoplasmic domains thereof (see, e.g., review Daëron, Annu. Rev. Immunol. 15:203-234 (1997)). FcRs are known (see, e.g., Ravetch and Kinet, Annu. Rev. Immunol. 9:457-492 (1991); Capel et al., Immunomethods 4:25-34 (1994); and de Haas et al., J. Lab. Clin. Med. 126:330-41 (1995)). Other FcRs, including those to be identified in the future, are encompassed by the term "FcR" herein. The term also includes the neonatal receptor, FcRn, which is responsible for the transfer of maternal IgGs to the fetus (see, e.g., Guyer et al., J. Immunol. 117:587 (1976) and Kim et al., J. Immunol. 24:249 (1994)). Antibody variants with improved or diminished binding to FcRs have been described (see, e.g., in WO 2000/42072; U.S. Pat. Nos. 7,183,387, 7,332,581 and 7,335,742; Shields et al. J. Biol. Chem. 9(2):6591-6604 (2001)).

"Complement dependent cytotoxicity" or "CDC" refers to the lysis of a target cell in the presence of complement. Activation of the classical complement pathway is initiated by the binding of the first component of the complement system (C1q) to antibodies (of the appropriate subclass) which are bound to their cognate antigen. To assess complement activation, a CDC assay, (see, e.g., Gazzano-Santoro et al., J. Immunol. Methods 202:163 (1996)), may be performed. Polypeptide variants with altered Fc region amino acid sequences (polypeptides with a variant Fc region) and increased or decreased C1q binding capability have been described, (see, e.g., U.S. Pat. No. 6,194,551, WO 1999/51642, Idusogie et al. J. Immunol. 164: 4178-4184 (2000)). Antibodies with little or no CDC activity may be selected for use.

In calculating percent identity, the sequences being compared may be aligned in a way that gives the largest match between the sequences. Computer program may be used to determine percent identity is the GCG program package, which includes GAP (Devereux et al., (1984) Nucl. Acid Res. 12:387; Genetics Computer Group, University of Wisconsin, Madison, Wis.). The computer algorithm GAP used to align the two polypeptides or polynucleotides for which the percent sequence identity is to be determined. The sequences may be aligned for optimal matching of their respective amino acid or nucleotide (the "matched span", as determined by the algorithm). A gap opening penalty (which is calculated as 3.times. the average diagonal, wherein the "average diagonal" is the average of the diagonal of the comparison matrix being used; the "diagonal" is the score or number assigned to each perfect amino acid match by the particular comparison matrix) and a gap extension penalty (which is usually 1/10 times the gap opening penalty), as well as a comparison matrix such as PAM 250 or BLOSUM 62 are used in conjunction with the algorithm. In certain embodiments, a standard comparison matrix (see, Dayhoff et al., (1978) Atlas of Protein Sequence and Structure 5:345-352 for the PAM 250 comparison matrix; Henikoff et al., (1992) Proc. Natl. Acad. Sci. U.S.A. 89:10915-10919 for the BLOSUM 62 comparison matrix) is also used by the algorithm.

Exemplary parameters for determining percent identity for polypeptides or nucleotide sequences using the GAP program are the following: (i) Algorithm: Needleman et al., 1970, J. Mol. Biol. 48:443-453; (ii) Comparison matrix: BLOSUM 62 from Henikoff et al., 1992, supra; (iii) Gap Penalty: 12 (but with no penalty for end gaps) (iv) Gap Length Penalty: 4; and (v) Threshold of Similarity: 0.

Certain alignment schemes for aligning two amino acid sequences may result in matching of only a short region of the two sequences, and this small aligned region may have very high sequence identity even though there is no significant relationship between the two full-length sequences. Accordingly, the selected alignment method (e.g., the GAP program) can be adjusted if so desired to result in an alignment that spans a number of amino acids, for example, at least 50 contiguous amino acids of the target polypeptide.

"Percent (%) amino acid sequence identity" with respect to a reference polypeptide sequence is defined as the percentage of amino acid residues in a candidate sequence that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for aligning sequences, including any algorithms needed to achieve maximal alignment over the full length of the sequences being compared.

A "modification" of an amino acid residue/position refers to a change of a primary amino acid sequence as compared to a starting amino acid sequence, wherein the change results from a sequence alteration involving said amino acid residue/positions. For example, typical modifications include substitution of the residue with another amino acid (e.g., a conservative or non-conservative substitution), insertion of one or more (e.g., generally fewer than 5, 4 or 3) amino acids adjacent to said residue/position, and/or deletion of said residue/position.

An "epitope" is the site on the surface of an antigen molecule to which a single antibody molecule binds, such as a localized region on the surface of an antigen, such as a GFRAL polypeptide, a GFRAL polypeptide fragment or a GFRAL epitope, that is capable of being bound to one or more antigen binding regions of an antibody, and that has antigenic or immunogenic activity in an animal, such as a mammal (e.g., a human), that is capable of eliciting an immune response. An epitope having immunogenic activity is a portion of a polypeptide that elicits an antibody response in an animal. An epitope having antigenic activity is a portion of a polypeptide to which an antibody binds as determined by any method well known in the art, including, for example, by an immunoassay. Antigenic epitopes need not necessarily be immunogenic. Epitopes often consist of chemically active surface groupings of molecules such as amino acids or sugar side chains and have specific three dimensional structural characteristics as well as specific charge characteristics. The term, "epitope" specifically includes linear epitopes and conformational epitopes. A region of a polypeptide contributing to an epitope may be contiguous amino acids of the polypeptide or the epitope may come together from two or more non-contiguous regions of the polypeptide. The epitope may or may not be a three-dimensional surface feature of the antigen. In certain embodiments, a GFRAL epitope is a three-dimensional surface feature of a GFRAL polypeptide. In other embodiments, a GFRAL epitope is linear feature of a GFRAL polypeptide. Generally an antigen has several or many different epitopes and may react with many different antibodies.

An antibody binds "an epitope" or "essentially the same epitope" or "the same epitope" as a reference antibody, when the two antibodies recognize identical, overlapping or adjacent epitopes in a three-dimensional space. The most widely used and rapid methods for determining whether two antibodies bind to identical, overlapping or adjacent epitopes in a three-dimensional space are competition assays, which can be configured in a number of different formats, for example, using either labeled antigen or labeled antibody. In some assays, the antigen is immobilized on a 96-well plate, or expressed on a cell surface, and the ability of unlabeled antibodies to block the binding of labeled antibodies is measured using radioactive, fluorescent or enzyme labels.

"Epitope mapping" is the process of identifying the binding sites, or epitopes, of antibodies on their target antigens. Antibody epitopes may be linear epitopes or conformational epitopes. Linear epitopes are formed by a continuous sequence of amino acids in a protein. Conformational epitopes are formed of amino acids that are discontinuous in the protein sequence, but which are brought together upon folding of the protein into its three-dimensional structure. Induced epitopes are formed when the three dimensional structure of the protein is in an altered confirmation, such as following activation or binding of another protein or ligand.

"Epitope binning" is the process of grouping antibodies based on the epitopes they recognize. More particularly, epitope binning comprises methods and systems for discriminating the epitope recognition properties of different antibodies, using competition assays combined with computational processes for clustering antibodies based on their epitope recognition properties and identifying antibodies having distinct binding specificities.

A "GFRAL-mediated disease," "GFRAL-mediated disorder," and "GFRAL-mediated condition" are used interchangeably and refer to any disease, disorder or condition that is completely or partially caused by or is the result of GFRAL or the interaction of a GFRAL with GDF15 and/or alternatively any disease, disorder, or condition in which it is desirable to inhibit the in vivo effects of GDF15. GFRAL-mediated diseases, disorders, or conditions include GDF15-mediated diseases disorders or conditions.

A "GDF15-mediated disease," "GDF15-mediated disorder," and "GDF15-mediated condition" are used interchangeably and refer to any disease, disorder or condition that is: (i) completely or partially caused by; or (ii) is the result of a GDF15 protein (e.g., an activity of a GDF15 protein, such as GDF15 signaling or elevated levels of a GDF15 protein) or the interaction of a GFRAL protein with a GDF15 protein and/or a RET protein, alternatively any disease, disorder, or condition in which it is desirable to inhibit the in vivo effects of GDF15. GDF15-mediated diseases, disorders, or conditions include involuntary weight loss, cachexia, sarcopenia, muscle wasting, bone wasting, a cardiovascular disease, a chronic inflammatory disease (e.g., chronic renal disease, chronic obstructive pulmonary disease), and a cancer, including a cancer that has decreased sensitivity to (e.g., resistance to) a chemotherapeutic agent (e.g., an anti-tumor antibody such as trastuzumab) that is induced by or related to a GDF15 protein.

The term "therapeutically effective amount" as used herein refers to the amount of an agent (e.g., an antibody described herein or any other agent described herein) that is sufficient to reduce and/or ameliorate the severity and/or duration of a given disease, disorder or condition, and/or a symptom related thereto. A therapeutically effective amount of a agent, including a therapeutic agent, can be an amount necessary for (i) reduction or amelioration of the advancement or progression of a given disease, disorder, or condition, (ii) reduction or amelioration of the recurrence, development or onset of a given disease, disorder, or conditions, and/or (iii) to improve or enhance the prophylactic or therapeutic effect of another therapy (e.g., a therapy other than the administration of an antibody provided herein). A "therapeutically effective amount" of a substance/molecule/agent of the present disclosure (e.g., an anti-GFRAL antibody) may vary according to factors such as the disease state, age, sex, and weight of the individual, and the ability of the substance/molecule/agent, to elicit a desired response in the individual. A therapeutically effective amount encompasses an amount in which any toxic or detrimental effects of the substance/molecule/agent are outweighed by the therapeutically beneficial effects. In certain embodiments, the term "therapeutically effective amount" refers to an amount of an antibody or other agent (e.g., or drug) effective to "treat" a disease, disorder, or condition, in a subject or mammal.

A "prophylactically effective amount" refers to an amount effective, at dosages and for periods of time necessary, to achieve the desired prophylactic result. Typically, but not necessarily, since a prophylactic dose is used in subjects prior to or at an earlier stage of a disease, disorder, or condition, a prophylactically effective amount may be less than a therapeutically effective amount.

"Chronic" administration refers to administration of the agent(s) in a continuous mode (e.g., for a period of time such as days, weeks, months or years) as opposed to an acute mode, so as to maintain the initial therapeutic effect (activity) for an extended period of time. "Intermittent" administration is treatment that is not consecutively done without interruption, but rather is cyclic in nature.

Administration "in combination with" one or more further agents includes simultaneous (e.g., concurrent) and consecutive administration in any order. The term "in combination" in the context of the administration of other therapies (e.g., other agents) includes the use of more than one therapy (e.g., one agent). The use of the term "in combination" does not restrict the order in which therapies are administered to a subject. A first therapy (e.g., agent) can be administered before (e.g., 1 minute, 15 minutes, 30 minutes, 45 minutes, 1 hour, 2 hours, 3 hours, 4 hours, 5 hours, 6 hours, 7 hours, 8 hours, 12 hours, 24 hours, 48 hours, 72 hours, 96 hours, 1 week, 2 weeks, 3 weeks, 4 weeks, 5 weeks, 6 weeks, 8 weeks, 8 weeks, 9 weeks, 10 weeks, 11 weeks, or 12 weeks), concurrently, or after (e.g., 1 minute, 15 minutes, 30 minutes, 45 minutes, 1 hour, 2 hours, 3 hours, 4 hours, 5 hours, 6 hours, 7 hours, 8 hours, 12 hours, 24 hours, 48 hours, 72 hours, 96 hours, 1 week, 2 weeks, 3 weeks, 4 weeks, 5 weeks, 6 weeks, 7 weeks, 8 weeks, 9 weeks, 10 weeks, 11 weeks, or 12 weeks) the administration of a second therapy (e.g., agent) to a subject which had, has, or is susceptible to or has a risk of a GDF15-mediated disease, disorder or condition.

Any additional therapy (e.g., agent) can be administered in any order with the other additional therapies (e.g., agents). In certain embodiments, the antibodies can be administered in combination with one or more therapies such as agents (e.g., therapies, including agents, that are not the antibodies that are currently administered) to prevent, treat, manage, and/or ameliorate a GDF15-mediated disease, disorder or condition, or a symptom thereof. Non-limiting examples of therapies (e.g., agents) that can be administered in combination with an antibody include, for example, analgesic agents, anesthetic agents, antibiotics, or immunomodulatory agents or any other agent listed in the *U.S. Pharmacopoeia* and/or *Physician's Desk Reference*. Examples of agents useful in combination therapy include, but are not limited to, the following: non-steroidal anti-inflammatory drug (NSAID) such as aspirin, ibuprofen, and other propionic acid derivatives (alminoprofen, benoxaprofen, bucloxic acid, carprofen, fenbufen, fenoprofen, fluprofen, flurbiprofen, indoprofen, ketoprofen, miroprofen, naproxen, oxaprozin, pirprofen, pranoprofen, suprofen, tiaprofenic acid, and tioxaprofen), acetic acid derivatives (indomethacin, acemetacin, alclofenac, clidanac, diclofenac, fenclofenac, fenclozic acid, fentiazac, fuirofenac, ibufenac, isoxepac, oxpinac, sulindac, tiopinac, tolmetin, zidometacin, and zomepirac), fenamic acid derivatives (flufenamic acid, meclofenamic acid, mefenamic acid, niflumic acid and tolfenamic acid), biphenylcarboxylic acid derivatives (diflunisal and flufenisal), oxicams (isoxicam, piroxicam, sudoxicam and tenoxican), salicylates (acetyl salicylic acid, sulfasalazine) and the pyrazolones (apazone, bezpiperylon, feprazone, mofebutazone, oxyphenbutazone, phenylbutazone). Other combinations include cyclooxygenase-2 (COX-2) inhibitors. Other agents for combination include steroids such as prednisolone, prednisone, methylprednisolone, betamethasone, dexamethasone, or hydrocortisone. Such a combination may be especially advantageous, since one or more side-effects of the steroid can be reduced or even eliminated by tapering the steroid dose required when treating subjects in combination with the present antibodies. Additional examples of agents for combinations include cytokine suppressive anti-inflammatory drug(s) (CSAIDs); antibodies to or antagonists of other human cytokines or growth factors, for example, TNF, LT, IL-1β, IL-2, IL-6, IL-7, IL-8, IL-15, IL-16, IL-18, EMAP-II, GM-CSF, FGF, or PDGF. Combinations of agents may include TNF antagonists like chimeric, humanized or human TNF antibodies, REMICADE, anti-TNF antibody fragments (e.g., CDP870), and soluble p55 or p75 TNF receptors, derivatives thereof, p75TNFRIgG (ENBREL®) or p55TNFR1gG (LENERCEPT®), soluble IL-13 receptor (sIL-13), and also TNFα converting enzyme (TACE) inhibitors; similarly IL-1 inhibitors (e.g., Interleukin-1-converting enzyme inhibitors) may be effective. Other combinations include Interleukin 11, anti-P7s and p-selectin glycoprotein ligand (PSGL). Other examples of agents useful in combination therapy include interferon-β1a (AVONEX); interferon-β1b (BETASE-RON®); copaxone; hyperbaric oxygen; intravenous immunoglobulin; clabribine; and antibodies to or antagonists of other human cytokines or growth factors (e.g., antibodies to CD40 ligand and CD80).

"Carriers" as used herein include pharmaceutically acceptable carriers, excipients, or stabilizers that are non-toxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight ((e.g., less than about 10 amino acid residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, polyethylene glycol (PEG), and PLURONICS™. The term "carrier" can also refer to a diluent, adjuvant (e.g., Freund's adjuvant (complete or incomplete)), excipient, or vehicle with which the therapeutic is administered. Such carriers, including pharmaceutical carriers, can be sterile liquids, such as water and oils, including those of petroleum, animal, vegetable or synthetic origin, such as peanut oil, soybean oil, mineral oil, sesame oil and the like. Water is a exemplary carrier when a composition (e.g., a pharmaceutical composition) is administered intravenously. Saline solutions and aqueous dextrose and glycerol solutions can also be employed as liquid carriers, particularly for injectable solutions. Suitable excipients (e.g., pharmaceutical excipients) include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. The composition, if desired, can also contain minor amounts of wetting or emulsifying agents, or pH buffering agents. Compositions can take the form of solutions, suspensions, emulsion, tablets, pills, capsules, powders, sustained-release formulations and the like. Oral compositions, including formulations, can include standard carriers such as pharmaceutical grades of mannitol, lactose, starch, magnesium stearate, sodium saccharine, cellulose, magnesium carbonate, etc. Examples of suitable pharmaceutical carriers are described in *Remington's Pharmaceutical Sciences* (1990) Mack Publishing Co., Easton, Pa. Compositions, including pharmaceutical compounds, may contain a prophylactically or therapeutically effective amount of an anti-GFRAL antibody, for example, in isolated or purified form, together with a suitable amount of carrier so as to provide the form for proper administration to the subject (e.g., patient). The formulation should suit the mode of administration.

The term "pharmaceutically acceptable" as used herein means being approved by a regulatory agency of the Federal or a state government, or listed in the U.S. Pharmacopeia, European Pharmacopeia or other generally recognized Pharmacopeia for use in animals, and more particularly in humans.

The term "pharmaceutical formulation" refers to a preparation which is in such form as to permit the biological activity of the active ingredient (e.g., an anti-GFRAL antibody) to be effective, and which contains no additional components which are unacceptably toxic to a subject to which the formulation would be administered. Such formulation may be sterile.

A "sterile" formulation is aseptic or free from all living microorganisms and their spores.

"Polyclonal antibodies" as used herein refers to an antibody population generated in an immunogenic response to a protein having many epitopes and thus includes a variety of different antibodies directed to the same and to different epitopes within the protein. Methods for producing polyclonal antibodies are known in the art (See, e.g., Chapter 11 in: *Short Protocols in Molecular Biology*, (2002) 5th Ed., Ausubel et al., eds., John Wiley and Sons, New York).

An "isolated nucleic acid" is a nucleic acid, for example, an RNA, DNA, or a mixed polymer, which is substantially separated from other genome DNA sequences as well as proteins or complexes such as ribosomes and polymerases, which naturally accompany a native sequence. An "isolated" nucleic acid molecule is one which is separated from other nucleic acid molecules which are present in the natural source of the nucleic acid molecule. Moreover, an "isolated" nucleic acid molecule, such as a cDNA molecule, can be substantially free of other cellular material, or culture medium when produced by recombinant techniques, or substantially free of chemical precursors or other chemicals when chemically synthesized. In a specific embodiment, one or more nucleic acid molecules encoding an antibody as described herein are isolated or purified. The term embraces nucleic acid sequences that have been removed from their naturally occurring environment, and includes recombinant or cloned DNA isolates and chemically synthesized analogues or analogues biologically synthesized by heterologous systems. A substantially pure molecule may include isolated forms of the molecule.

"Polynucleotide," or "nucleic acid," as used interchangeably herein, refer to polymers of nucleotides of any length, and include DNA and RNA. The nucleotides can be deoxyribonucleotides, ribonucleotides, modified nucleotides or bases, and/or their analogs, or any substrate that can be incorporated into a polymer by DNA or RNA polymerase or by a synthetic reaction. A polynucleotide may comprise modified nucleotides, such as methylated nucleotides and their analogs. "Oligonucleotide," as used herein, generally refers to short, generally single-stranded, generally synthetic polynucleotides that are generally, but not necessarily, less than about 200 nucleotides in length. The terms "oligonucleotide" and "polynucleotide" are not mutually exclusive. The description above for polynucleotides is equally and fully applicable to oligonucleotides. A cell that produces an anti-GFRAL antibody of the present disclosure may include a parent hybridoma cell, as well as bacterial and eukaryotic host cells into which nucleic acid encoding the antibodies have been introduced. Suitable host cells are disclosed below.

As used herein, the terms "treat," "treatment" and "treating" refer to the reduction or amelioration of the progression, severity, and/or duration of a GDF15-mediated disease, disorder or condition resulting from the administration of one or more therapies (including, but not limited to, the administration of one or more prophylactic or therapeutic agents, such as an antibody provided herein). In some embodiments, the agent is an anti-GFRAL antibody. Treatment as used herein includes, but is not limited to, (i) increase body weight; (ii) maintain body weight; (iii) reduce body weight loss; (iv) increase body mass (e.g., lean mass or fat mass); (v) maintain body mass (e.g., lean mass or fat mass); (vi) reduce loss of body mass (e.g., lean mass or fat mass), or any combination thereof.

As used herein, the term "prophylactic agent" refers to any agent that can totally or partially inhibit the development, recurrence, onset or spread of a GDF15-mediated disease, disorder or condition and/or symptom related thereto in a subject. In some embodiments, the term "prophylactic agent" refers to an antibody provided herein. In some embodiments, the term "prophylactic agent" refers to an agent other than an antibody provided herein. In some embodiments, a prophylactic agent is an agent which is known to be useful to or has been or is currently being used to prevent a GDF15-mediated disease, disorder or condition and/or a symptom related thereto or impede the onset, development, progression and/or severity of a GDF15-mediated disease, disorder or condition and/or a symptom related thereto. In some embodiments, the prophylactic agent is a fully human anti-GFRAL antibody, such as a fully human anti-GFRAL monoclonal antibody.

The term "prophylactic agent" refers to any agent that can totally or partially inhibit the development, recurrence, onset or spread of a GDF15-mediated disease, disorder or condition, or a symptom thereof in a subject. In certain embodiments, the term "prophylactic agent" refers to an anti-GFRAL antibody as described herein. In certain other embodiments, the term "prophylactic agent" refers to an agent other than an anti-GFRAL antibody as described herein. In certain embodiments, a prophylactic agent is an agent which is known to be useful to or has been or is currently being used to prevent a GDF15-mediated disease, disorder or condition, or a symptom thereof or impede the onset, development, progression and/or severity of a GDF15-mediated disease, disorder or condition, or a symptom thereof. In specific embodiments, the prophylactic agent is a humanized anti-GFRAL antibody, such as a humanized anti-GFRAL monoclonal antibody.

The term "package insert" is used to refer to instructions customarily included in commercial packages of therapeutic products, that contain information about the indications, usage, dosage, administration, contraindications and/or warnings concerning the use of such therapeutic products.

The terms "prevent," "preventing," and "prevention" refer to the total or partial inhibition of the development, recurrence, onset or spread of a GDF15-mediated disease, disorder or condition, or a symptom thereof, resulting from the administration of a therapy or combination of therapies provided herein (e.g., a combination of prophylactic or therapeutic agents, such as an antibody provided herein).

The term "recombinant antibody" refers to an antibody that is prepared, expressed, created or isolated by recombinant means. Recombinant antibodies can be antibodies expressed using a recombinant expression vector transfected into a host cell, antibodies isolated from a recombinant, combinatorial antibody library, antibodies isolated from an animal (e.g., a mouse or cow) that is transgenic and/or transchromosomal for human immunoglobulin genes (see, e.g., Taylor, L. D. et al. (1992) Nucl. Acids Res. 20:6287-6295) or antibodies prepared, expressed, created or isolated by any other means that involves splicing of immunoglobulin gene sequences to other DNA sequences. Such recombinant antibodies can have variable and constant regions, including those derived from human germline immunoglobulin sequences (See Kabat, E. A. et al. (1991) *Sequences of Proteins of Immunological Interest*, Fifth Edition, U.S. Department of Health and Human Services, NIH Publication No. 91-3242). In certain embodiments, however, such recombinant antibodies may be subjected to in vitro mutagenesis (or, when an animal transgenic for human Ig sequences is used, in vivo somatic mutagenesis) and thus the amino acid sequences of the VH and VL regions of the recombinant antibodies are sequences that, while derived from and related to human germ line VH and VL sequences, may not naturally exist within the human antibody germ line repertoire in vivo.

The term "side effects" encompasses unwanted and adverse effects of a therapy (e.g., a prophylactic or therapeutic agent). Unwanted effects are not necessarily adverse. An adverse effect from a therapy (e.g., a prophylactic or therapeutic agent) might be harmful or uncomfortable or risky. Examples of side effects include, diarrhea, cough, gastroenteritis, wheezing, nausea, vomiting, anorexia, abdominal cramping, fever, pain, loss of body weight, dehydration, alopecia, dyspenea, insomnia, dizziness, mucositis, nerve and muscle effects, fatigue, dry mouth, and loss of appetite, rashes or swellings at the site of administration, flu-like symptoms such as fever, chills and fatigue, digestive tract problems and allergic reactions. Additional undesired effects experienced by patients are numerous and known in the art. Many are described in the *Physician's Desk Reference* ($60^{th}$ ed., 2006).

The terms "subject" and "patient" are used interchangeably herein and, in the context of the methods disclosed herein, refer to an animal that is the recipient of a therapy or preventive case. As used herein, in certain embodiments, a subject is a mammal, such as a non-primate (e.g., cows, pigs, horses, cats, dogs, rats, etc.) or a primate (e.g., monkey and human). In specific embodiments, the subject is a human. In one embodiment, the subject is a mammal (e.g., a human) having a GDF15-mediated disease, disorder or condition. In another embodiment, the subject is a mammal (e.g., a human) at risk of developing a GDF15-mediated disease, disorder or condition.

"Substantially all" refers to refers to at least about 60%, at least about 65%, at least about 70%, at least about 75%, at least about 80%, at least about 85%, at least about 90%, at least about 95%, at least about 96%, at least about 97%, at least about 98%, at least about 99%, or about 100%.

The term "therapeutic agent" refers to any agent that can be used in treating, preventing or alleviating a disease, disorder or condition, including in the treatment, prevention or alleviation of one or more symptoms of a GDF15-mediated disease, disorder or condition, or a symptom thereof. In certain embodiments, a therapeutic agent refers to an anti-GFRAL antibody as described herein. In certain other embodiments, a therapeutic agent refers to an agent other than an antibody provided herein. In certain embodiments, a therapeutic agent is an agent which is known to be useful for, or has been or is currently being used for the treatment, prevention or alleviation of one or more symptoms of a GDF15-mediated disease, disorder or condition, or a symptom thereof.

The combination of therapies (e.g., use of prophylactic or therapeutic agents) which is more effective than the additive effects of any two or more single therapy. For example, a synergistic effect of a combination of prophylactic and/or therapeutic agents permits the use of lower dosages of one or more of the agents and/or less frequent administration of the agents to a subject with a GDF15-mediated disease, disorder or condition. The ability to utilize lower dosages of prophylactic or therapeutic therapies and/or to administer the therapies less frequently reduces the toxicity associated with the administration of the therapies to a subject without reducing the efficacy of the therapies in the prevention, management, treatment or amelioration of a GDF15-mediated disease, disorder or condition. In addition, a synergistic effect can result in improved efficacy of therapies in the prevention, or in the management, treatment or amelioration of a GDF15-mediated disease, disorder or condition. Finally, synergistic effect of a combination of therapies (e.g., prophylactic or therapeutic agents) can avoid or reduce adverse or unwanted side effects associated with the use of any single therapy. In some embodiments, the combination therapy comprises an antibody provided herein and insulin (e.g., insulin supplementation). In some embodiments, the combination therapy comprises an-anti-GFRAL antibody and insulin, wherein the combination therapy comprises insulin at a lower daily dosage than the normal daily dosage in an insulin-only therapy. In some embodiments, the combination therapy comprises, e.g., less than 90%, less than 80%, less than 70%, less than 60%, less than 50%, less than 40%, less than 30%, less than 20%, less than 15%, less than 10%, less than 5%, less than 3%, or less than 1% of the normal daily insulin dosage in an insulin-only therapy.

The term "therapy" refers to any protocol, method and/or agent that can be used in the prevention, management, treatment and/or amelioration of a GDF15-mediated disease, disorder or condition (e.g., type 1 diabetes or type 2 diabetes). In some embodiments, the terms "therapies" and "therapy" refer to a biological therapy, supportive therapy, and/or other therapies useful in the prevention, management, treatment and/or amelioration of a GDF15-mediated disease, disorder or condition known to one of skill in the art such as medical personnel.

The term "detectable probe" refers to a composition that provides a detectable signal. The term includes, without limitation, any fluorophore, chromophore, radiolabel, enzyme, antibody or antibody fragment, and the like, that provide a detectable signal via its activity.

The term "diagnostic agent" refers to a substance administered to a subject that aids in the diagnosis of a disease, disorder, or conditions. Such substances can be used to reveal, pinpoint, and/or define the localization of a disease causing process. In certain embodiments, a diagnostic agent includes a substance that is conjugated to an anti-GFRAL antibody as described herein, that when administered to a subject or contacted to a sample from a subject aids in the diagnosis a GDF15-mediated disease, disorder or condition.

The term "detectable agent" refers to a substance that can be used to ascertain the existence or presence of a desired molecule, such as an anti-GFRAL antibody as described herein, in a sample or subject. A detectable agent can be a substance that is capable of being visualized or a substance that is otherwise able to be determined and/or measured (e.g., by quantitation).

The term "encode" or grammatical equivalents thereof as it is used in reference to nucleic acid molecule refers to a nucleic acid molecule in its native state or when manipulated by methods well known to those skilled in the art that can be transcribed to produce mRNA, which is then translated into a polypeptide and/or a fragment thereof. The antisense strand is the complement of such a nucleic acid molecule, and the encoding sequence can be deduced therefrom.

The term "excipient" refers to an inert substance which is commonly used as a diluent, vehicle, preservative, binder, or stabilizing agent, and includes, but not limited to, proteins (e.g., serum albumin, etc.), amino acids (e.g., aspartic acid, glutamic acid, lysine, arginine, glycine, histidine, etc.), fatty acids and phospholipids (e.g., alkyl sulfonates, caprylate, etc.), surfactants (e.g., SDS, polysorbate, nonionic surfactant, etc.), saccharides (e.g., sucrose, maltose, trehalose, etc.) and polyols (e.g., mannitol, sorbitol, etc.). See, also, *Remington's Pharmaceutical Sciences* (1990) Mack Publishing Co., Easton, Pa., which is hereby incorporated by reference in its entirety.

In the context of a peptide or polypeptide, the term "fragment" as used herein refers to a peptide or polypeptide that comprises less than the full length amino acid sequence. Such a fragment may arise, for example, from a truncation at the amino terminus, a truncation at the carboxy terminus, and/or an internal deletion of a residue(s) from the amino acid sequence. Fragments may, for example, result from alternative RNA splicing or from in vivo protease activity. In certain embodiments, fragments include polypeptides comprising an amino acid sequence of at least 5 contiguous amino acid residues, at least 10 contiguous amino acid residues, at least 15 contiguous amino acid residues, at least 20 contiguous amino acid residues, at least 25 contiguous amino acid residues, at least 40 contiguous amino acid residues, at least 50 contiguous amino acid residues, at least 60 contiguous amino residues, at least 70 contiguous amino acid residues, at least 80 contiguous amino acid residues, at least 90 contiguous amino acid residues, at least contiguous 100 amino acid residues, at least 125 contiguous amino acid residues, at least 150 contiguous amino acid residues, at least 175 contiguous amino acid residues, at least 200 contiguous amino acid residues, at least 250, at least 300, at least 350, at least 400, at least 450, at least 500, at least 550, at least 600, at least 650, at least 700, at least 750, at least 800, at least 850, at least 900, or at least 950, contiguous amino acid residues of the amino acid sequence of a GFRAL polypeptide or an antibody that binds to a GFRAL polypeptide. In some embodiments, a fragment of an antibody that binds to a GFRAL polypeptide retains at least 1, at least 2, or at least 3 or more functions of the antibody.

The terms "manage," "managing," and "management" refer to the beneficial effects that a subject derives from a therapy (e.g., a prophylactic or therapeutic agent), which does not result in a cure of the disease. In certain embodiments, a subject is administered one or more therapies (e.g., prophylactic or therapeutic agents, such as an antibody provided herein) to "manage" a GDF15-mediated disease, disorder or condition, or a symptom thereof, so as to prevent the progression or worsening of the disease.

"Administer" or "administration" refers to the act of injecting or otherwise physically delivering a substance as it exists outside the body (e.g., an anti-GFRAL antibody as described herein) into a subject, such as by mucosal, intradermal, intravenous, intramuscular delivery and/or any other method of physical delivery described herein or known in the art. When a disease, disorder, or condition, or a symptom thereof, is being treated, administration of the substance typically occurs after the onset of the disease, disorder, or condition, or symptoms thereof. When a disease, disorder, or condition or symptoms thereof, are being prevented, administration of the substance typically occurs before the onset of the disease, disorder, or condition, or symptoms thereof.

In the context of a polypeptide, the term "analog" as used herein refers to a polypeptide that possesses a similar or identical function as a GFRAL polypeptide, a fragment of a GFRAL polypeptide, or an anti-GFRAL antibody but does not necessarily comprise a similar or identical amino acid sequence of a GFRAL polypeptide, a fragment of a GFRAL polypeptide, or an anti-GFRAL antibody, or possess a similar or identical structure of a GFRAL polypeptide, a fragment of a GFRAL polypeptide, or an anti-GFRAL antibody. A polypeptide that has a similar amino acid sequence refers to a polypeptide that satisfies at least one of the following: (a) a polypeptide having an amino acid sequence that is at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% identical to the amino acid sequence of a GFRAL polypeptide (e.g., SEQ ID NO:500, a fragment of a GFRAL polypeptide, or an anti-GFRAL antibody described herein; (b) a polypeptide encoded by a nucleotide sequence that hybridizes under stringent conditions to a nucleotide sequence encoding a GFRAL polypeptide, a fragment of a GFRAL polypeptide, or an anti-GFRAL antibody (or VH or VL region thereof) described herein of at least 5 amino acid residues, at least 10 amino acid residues, at least 15 amino acid residues, at least 20 amino acid residues, at least 25 amino acid residues, at least 40 amino acid residues, at least 50 amino acid residues, at least 60 amino residues, at least 70 amino acid residues, at least 80 amino acid residues, at least 90 amino acid residues, at least 100 amino acid residues, at least 125 amino acid residues, or at least 150 amino acid residues (see, e.g., Sambrook et al. (2001) *Molecular Cloning: A Laboratory Manual*, Cold Spring Harbor Laboratory Press, Cold Spring Harbor, N.Y.; Maniatis et al. (1982) *Molecular Cloning: A Laboratory Manual*, Cold Spring Harbor Press, Cold Spring Harbor, N.Y.); and (c) a polypeptide encoded by a nucleotide sequence that is at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% identical to the nucleotide sequence encoding a GFRAL polypeptide, a fragment of a GFRAL polypeptide, or an anti-GFRAL antibody (or VH or VL region thereof) described herein. A polypeptide with similar structure to a GFRAL polypeptide, a fragment of a GFRAL polypeptide, or an anti-GFRAL antibody described herein refers to a polypeptide that has a similar secondary, tertiary or quaternary structure of a GFRAL polypeptide, a fragment of a GFRAL, or a GFRAL antibody described herein. The structure of a polypeptide can determined by methods known to those skilled in the art, including but not limited to, X-ray crystallography, nuclear magnetic resonance, and crystallographic electron microscopy.

The term "composition" is intended to encompass a product containing the specified ingredients (e.g., an antibody provided herein) in, optionally, the specified amounts, as well as any product which results, directly or indirectly, from combination of the specified ingredients in, optionally, the specified amounts.

In the context of a polypeptide, the term "derivative" as used herein refers to a polypeptide that comprises an amino acid sequence of a GFRAL polypeptide, a fragment of a GFRAL polypeptide, or an antibody that binds to a GFRAL polypeptide which has been altered by the introduction of amino acid residue substitutions, deletions or additions. The term "derivative" as used herein also refers to a GFRAL polypeptide, a fragment of a GFRAL polypeptide, or an antibody that binds to a GFRAL polypeptide which has been chemically modified, e.g., by the covalent attachment of any type of molecule to the polypeptide. For example, but not by way of limitation, a GFRAL polypeptide, a fragment of a GFRAL polypeptide, or a GFRAL antibody may be chemically modified, e.g., by glycosylation, acetylation, pegylation, phosphorylation, amidation, derivatization by known protecting/blocking groups, proteolytic cleavage, linkage to a cellular ligand or other protein, etc. The derivatives are modified in a manner that is different from naturally occurring or starting peptide or polypeptides, either in the type or location of the molecules attached. Derivatives further include deletion of one or more chemical groups which are naturally present on the peptide or polypeptide. A derivative of a GFRAL polypeptide, a fragment of a GFRAL polypeptide, or a GFRAL antibody may be chemically modified by chemical modifications using techniques known to those of skill in the art, including, but not limited to specific chemical cleavage, acetylation, formulation, metabolic synthesis of tunicamycin, etc. Further, a derivative of a GFRAL polypeptide, a fragment of a GFRAL polypeptide, or a GFRAL antibody may contain one or more non-classical amino acids. A polypeptide derivative possesses a similar or identical function as a GFRAL polypeptide, a fragment of a GFRAL polypeptide, or a GFRAL antibody described herein.

The term "involuntary body weight loss" refers to the unintended loss of body weight that is observed in many conditions such as cachexia, liver cirrhosis, hyperthyroidism, chronic kidney disease, Parkinson's disease, cancer, eating disorder, and sarcopenia.

The term "cachexia" refers to wasting syndrome that is marked with loss of weight, muscle atrophy, fatigue, weakness, and significant loss of appetite in someone who is not actively trying to lose weight. Cachexia can greatly contribute to morbidity of patients suffering from some chronic diseases (e.g., cancer, chronic renal disease, chronic inflammatory disease, muscle wasting, such as muscular dystrophy, and anorexia nervosa). For example, in late stage cancer, cachexia is common (occurring in most terminally ill cancer patients), and is responsible for about a quarter of all cancer-related deaths.

Compositions and Methods of Making the Same

Binding proteins such as antibodies that bind to GFRAL (e.g., human GFRAL) are provided. Antibodies of the present disclosure are useful, for example, for the diagnosis or treatment of GDF15-mediated diseases, disorders, or conditions. In certain embodiments, antibodies of the present disclosure are useful for the diagnosis or treatment of a disease, disorder, or condition, such as involuntary body weight loss, including, but not limited to, involuntary body weight loss in a subject suffering from cachexia or a chronic disease (e.g., liver cirrhosis, hyperthyroidism, Parkinson's disease, cancer, chronic renal disease, chronic obstructive pulmonary disease, AIDS, tuberculosis, chronic inflammatory disease, sepsis, muscle wasting, and anorexia nervosa) or broadly any disease, disorder, or condition in which it is desirable to inhibit the in vivo effects of GDF15.

Provided herein are antibodies (e.g., monoclonal antibodies) that bind to a GFRAL polypeptide, a GFRAL polypeptide fragment, GFRAL peptide, or a GFRAL epitope. In some embodiments, the anti-GFRAL antibodies bind to the extracellular domain (ECD) of GFRAL. Also provided are antibodies that competitively block an anti-GFRAL antibody provided herein from binding to a GFRAL polypeptide. The anti-GFRAL antibodies provided herein can also be conjugated or recombinantly fused to a diagnostic agent, detectable agent or therapeutic agent. Further provided are compositions comprising an anti-GFRAL antibody.

Also provided herein are isolated nucleic acid molecules encoding an immunoglobulin heavy chain, light chain, VH region, VL region, VH CDR1, VH CDR2, VH CDR3, VL CDR1, VL CDR2, and/or VL CDR3 of anti-GFRAL antibodies that bind to a GFRAL polypeptide, a GFRAL polypeptide fragment, a GFRAL peptide or a GFRAL epitope. Further provided are vectors and host cells comprising nucleic acid molecules encoding anti-GFRAL antibodies that bind to a GFRAL polypeptide, a GFRAL polypeptide fragment, a GFRAL peptide or a GFRAL epitope. Also provided are methods of making antibodies that bind to a GFRAL polypeptide, a GFRAL polypeptide fragment, a GFRAL peptide or a GFRAL epitope.

Methods of using the anti-GFRAL antibodies are provided herein. The methods include treating, preventing or alleviating a GDF15-mediated disease, disorder or condition, including treating, preventing or alleviating one or more symptoms of a GDF15-mediated disease, disorder or condition in a subject (e.g., patient). Non limiting examples of GDF15-mediated diseases, disorders, or conditions include involuntary weight loss, a waisting disease, involuntary body weight loss in a subject suffering from cachexia or a chronic disease (e.g., liver cirrhosis, hyperthyroidism, Parkinson's disease, cancer, chronic renal disease, chronic obstructive pulmonary disease, AIDS, tuberculosis, chronic inflammatory disease, sepsis, muscle wasting, and anorexia nervosa). Other of diseases, disorders, or conditions in which a subject can suffer from involuntary weight loss include eating disorders, muscular dystrophy or multiple sclerosis.

Anti-GFRAL Antibodies

In some embodiments, the present disclosure provides anti-GFRAL antibodies that may find use herein as therapeutic agents. Exemplary antibodies include polyclonal, monoclonal, humanized, human, bispecific, and heteroconjugate antibodies, as well as variants thereof having improved affinity or other properties.

In some embodiments, provided herein are antibodies that bind to GFRAL, including a GFRAL polypeptide, a GFRAL polypeptide fragment, a GFRAL peptide or a GFRAL epitope. In some embodiments the anti-GFRAL antibodies are humanized antibodies (e.g., comprising human constant regions) that bind GFRAL, including GFRAL polypeptide, a GFRAL polypeptide fragment, a GFRAL peptide or a GFRAL epitope.

In some embodiments, an anti-GFRAL antibody comprises a VH region, VL region, VH CDR1, VH CDR2, VH CDR3, VL CDR1, VL CDR2, and/or VL CDR3 of any one of the monoclonal antibodies described herein (e.g., 1C1, 3P10, 12A3, 5F12, 5A20, 8D8, 17J16, 25M22, 2B8, 22N5, 2I23, 6N16, 1B3, 19K19, 2B3, 8C10, 2A9, 24G2, 6G9, 2B11, 1A3, P1B6, P1H8, or P8G4), such as an amino acid sequence depicted in Tables 1-24. Accordingly, in some embodiments, the isolated antibody or functional fragment thereof provided herein comprises one, two, and/or three heavy chain CDRs and/or one, two, and/or three light chain CDRs from: (a) the antibody designated 1C1; (b) the antibody designated 3P10; (c) the antibody designated 12A3; (d) the antibody designated 5F12; (e) the antibody designated 5A20; (f) the antibody designated 8D8; (g) the antibody designated 17J16; (h) t the antibody designated 25M22; (i) the antibody designated 2B8; (j) the antibody designated 22N5; (k) the antibody designated 2I23; (l) the antibody designated 6N16; (m) the antibody designated 1B3; (n) the antibody designated 19K19; (o) the antibody designated 2B3; (p) the antibody designated 8C10; (q) the antibody designated 2A9; (r) the antibody designated 24G2; (s) the antibody designated 6G9; (t) the antibody designated 2B11; (u) the antibody designated 1A3; (v) the antibody designated P1B6; (w) the antibody designated P1H8; (x) the antibody designated P8G4; or the antibody designated 1C1 to P8G4, as shown in Tables 1-24.

The antibody designated 1C1 comprises a VH sequence that is SEQ ID NO: 1 and a VL sequence that is SEQ ID NO: 2.

The antibody designated 3P10 comprises a VH sequence that is SEQ ID NO: 3 and a VL sequence that is SEQ ID NO: 4, The antibody designated 12A3 comprises a VH sequence that is SEQ ID NO: 5 and a VL sequence that is SEQ ID NO: 6.

The antibody designated 5F12 comprises a VH sequence that is SEQ ID NO: 7 and a VL sequence that is SEQ ID NO: 8.

The antibody designated 5A20 comprises a VH sequence that is SEQ ID NO: 9 and a VL sequence that is SEQ ID NO: 10.

The antibody designated 8D8 comprises a VH sequence that is SEQ ID NO: 11 and a VL sequence that is SEQ ID NO: 12.

The antibody designated 17J16 comprises a VH sequence that is SEQ ID NO: 13 and a VL sequence that is SEQ ID NO: 14.

The antibody designated 25M22 comprises a VH sequence that is SEQ ID NO: 15 and a VL sequence that is SEQ ID NO: 16.

The antibody designated 2B8 comprises a VH sequence that is SEQ ID NO: 17 and a VL sequence that is SEQ ID NO: 18.

The antibody designated 22N5 comprises a VH sequence that is SEQ ID NO: 19 and a VL sequence that is SEQ ID NO: 20.

The antibody designated 2I23 comprises a VH sequence that is SEQ ID NO: 21 and a VL sequence that is SEQ ID NO: 22.

The antibody designated 6N16 comprises a VH sequence that is SEQ ID NO: 23 and a VL sequence that is SEQ ID NO: 24.

The antibody designated 1B3 comprises a VH sequence that is SEQ ID NO: 25 and a VL sequence that is SEQ ID NO: 26.

The antibody designated 19K19 comprises a VH sequence that is SEQ ID NO: 27 and a VL sequence that is SEQ ID NO: 28.

The antibody designated 2B3 comprises a VH sequence that is SEQ ID NO: 29 and a VL sequence that is SEQ ID NO: 30.

The antibody designated 8C10 comprises a VH sequence that is SEQ ID NO: 31 and a VL sequence that is SEQ ID NO: 32.

The antibody designated 2A9 comprises a VH sequence that is SEQ ID NO: 33 and a VL sequence that is SEQ ID NO: 34.

The antibody designated 24G2 comprises a VH sequence that is SEQ ID NO: 35 and a VL sequence that is SEQ ID NO: 36.

The antibody designated 6G9 comprises a VH sequence that is SEQ ID NO: 37 and a VL sequence that is SEQ ID NO: 38.

The antibody designated 2B11 comprises a VH sequence that is SEQ ID NO: 39 and a VL sequence that is SEQ ID NO: 40.

The antibody designated 1A3 comprises a VH sequence that is SEQ ID NO: 480 and a VL sequence that is SEQ ID NO: 481.

The antibody designated P1B6 comprises a VH sequence that is SEQ ID NO: 482 and a VL sequence that is SEQ ID NO: 483.

The antibody designated P1H8 comprises a VH sequence that is SEQ ID NO: 484 and a VL sequence that is SEQ ID NO: 485.

The antibody designated P8G4 comprises a VH sequence that is SEQ ID NO: 486 and a VL sequence that is SEQ ID NO: 487.

TABLE 1

Antibody 1C1 CDR Sequences

|  |  | Exemplary | IMGT | Kabat |
|---|---|---|---|---|
| VH CDR Seq. | VH CDR1 | GFSLNDYGVH (SEQ ID NO: 41) | GFSLNDYG (SEQ ID NO: 42) | DYGVH (SEQ ID NO: 43) |
|  | VH CDR2 | VIWSGGRTDYNAAFIS (SEQ ID NO: 132) | IWSGGRT (SEQ ID NO: 133) | VIWSGGRTDYNAAFIS (SEQ ID NO: 132) |
|  | VH CDR3 | WALYFLYGGSMDY (SEQ ID NO: 221) | ARWALYFLYGGSMDY (SEQ ID NO: 222) | WALYFLYGGSMD (SEQ ID NO: 221) |
| VL CDR Seq. | VL CDR1 | RSSQSLVHSSGITYLH (SEQ ID NO: 297) | QSLVHSSGITY (SEQ ID NO: 298) | RSSQSLVHSSGITYLH (SEQ ID NO: 297) |
|  | VL CDR2 | KLSNRFS (SEQ ID NO: 373) | KLS (SEQ ID NO: 374) | KLSNRFS (SEQ ID NO: 373) |
|  | VL CDR3 | SQSTHVPPWT (SEQ ID NO: 423) | SQSTHVPPWT (SEQ ID NO: 423) | SQSTHVPPWT (SEQ ID NO: 424) |
|  |  | Chothia | Contact | AbM |
| VH CDR Seq. | VH CDR1 | GFSLNDY (SEQ ID NO: 44) | NDYGVH (SEQ ID NO: 45) | GFSLNDYGVH (SEQ ID NO: 41) |
|  | VH CDR2 | SGG (SEQ ID NO: 134) | WLGVIWSGGRTD (SEQ ID NO: 135) | VIWSGGRTD (SEQ ID NO: 136) |
|  | VH CDR3 | ALYFLYGGSMD (SEQ ID NO: 223) | ARWALYFLYGGSMD (SEQ ID NO: 224) | WALYFLYGGSMD (SEQ ID NO: 221) |
| VL CDR Seq. | VL CDR1 | SQSLVHSSGITY (SEQ ID NO: 299) | VHSSGITYLHWY (SEQ ID NO: 300) | RSSQSLVHSSGITYLH (SEQ ID NO: 297) |
|  | VL CDR2 | KLS (SEQ ID NO: 374) | LLIYKLSNRF (SEQ ID NO: 375) | KLSNRFS (SEQ ID NO: 373) |
|  | VL CDR3 | STHVPPW (SEQ ID NO: 425) | SQSTHVPPW (SEQ ID NO: 423) | SQSTHVPPWT (SEQ ID NO: 423) |

VH Sequence: QMQLKQSGPGLVQPSQSLSITCTVSGFSLNDYGVHWIRQSPGKGLEWLGVIWSGGRTDY-NAAFISRLSISKDNSKSQVFFKMSSLQPQDTAIYYCARWALYFLYGGSMDYWGQGTSVTVSS (SEQ ID NO: 1)
VL Sequence: DVVLTQTPLSLPVSPGDQASISCRSSQSLVHSSGITYLHWYLQKPGQSPKLLIYKLSNRF-SGVPDRFSGSGSGTDFTLKISRVEAEDLGVYFCSQSTHVPPWTFGGGTKLEIK (SEQ ID NO: 2)

TABLE 2

Antibody 3P10 CDR Sequences

|  |  | Exemplary | IMGT | Kabat |
|---|---|---|---|---|
| VH CDR Seq. | VH CDR1 | GYTFTDYGVI (SEQ ID NO: 46) | GYTFTDYG (SEQ ID NO: 47) | DYGVI (SEQ ID NO: 48) |
|  | VH CDR2 | WINTYTGEPTYADDLKG (SEQ ID NO: 137) | INTYTGEP (SEQ ID NO: 138) | WINTYTGEPTYADDLKG (SEQ ID NO: 137) |
|  | VH CDR3 | RYGPEDIDY (SEQ ID NO: 225) | ARRYGPEDIDY (SEQ ID NO: 226) | RYGPEDIDY (SEQ ID NO: 225) |
| VL CDR Seq. | VL CDR1 | RASESVDNYGISFMS (SEQ ID NO: 301) | ESVDNYGISF (SEQ ID NO: 302) | RASESVDNYGISFMS (SEQ ID NO: 301) |
|  | VL CDR2 | AASHQGS (SEQ ID NO: 376) | AAS (SEQ ID NO: 377) | AASHQGS (SEQ ID NO: 376) |
|  | VL CDR3 | LQSKEVPWT (SEQ ID NO: 426) | LQSKEVPWT (SEQ ID NO: 426) | LQSKEVPWT (SEQ ID NO: 426) |
|  |  | Chothia | Contact | AbM |
| VH CDR Seq. | VH CDR1 | GYTFTDY (SEQ ID NO: 49) | TDYGVI (SEQ ID NO: 50) | GYTFTDYGVI (SEQ ID NO: 46) |
|  | VH CDR2 | TYTG (SEQ ID NO: 139) | WMGWINTYTGEPT (SEQ ID NO: 140) | WINTYTGEPT (SEQ ID NO: 141) |
|  | VH CDR3 | YGPEDID (SEQ ID NO: 227) | ARRYGPEDID (SEQ ID NO: 228) | RYGPEDIDY (SEQ ID NO: 225) |

TABLE 2-continued

Antibody 3P10 CDR Sequences

| | | | | |
|---|---|---|---|---|
| VL CDR Seq. | VL CDR1 | SESVDNYGISF (SEQ ID NO: 303) | DNYGISFMSWF (SEQ ID NO: 304) | RASESVDNYGISF MS (SEQ ID NO: 301) |
| | VL CDR2 | AAS (SEQ ID NO: 377) | LLIYAASHQG (SEQ ID NO: 378) | AASHQGS (SEQ ID NO: 376) |
| | VL CDR3 | SKEVPW (SEQ ID NO: 427) | LQSKEVPW (SEQ ID NO: 428) | LQSKEVPWT (SEQ ID NO: 426) |

VH Sequence: QIQLVQSGPELKKPGETVKISCKASGYTFTDYGVIWVKQAPGKALKWMGWINTYTGEPTY-ADDLKGRFAFSLETSASSASLQINNLKNEDTATYFCARRYGPEDIDYWGQGTTLTVSS (SEQ ID NO: 3)
VL Sequence: DIVLTQSPVSLAVSLGQRATISCRASESVDNYGISFMSWFQQKPGQPPKLLIYAASHQGS-GVPARFSGSGSGTDFSLNIHPMEEDDSAMYFCLQSKEVPWTFGGGTKLEIK (SEQ ID NO: 4)

TABLE 3

Antibody 12A3 CDR Sequences

| | | Exemplary | IMGT | Kabat |
|---|---|---|---|---|
| VH CDR Seq. | VH CDR1 | GYPFTIYGMN (SEQ ID NO: 51) | GYPFTIYG (SEQ ID NO: 52) | IYGMN (SEQ ID NO: 53) |
| | VH CDR2 | WINTYSGVPTYAD DFKG (SEQ ID NO: 142) | INTYSGVP (SEQ ID NO: 143) | WINTYSGVPTYAD DFKG (SEQ ID NO: 142) |
| | VH CDR3 | ATGNY (SEQ ID NO: 229) | ASATGNY (SEQ ID NO: 230) | ATGNY (SEQ ID NO: 229) |
| VL CDR Seq. | VL CDR1 | RASQDIGSSLN (SEQ ID NO: 305) | QDIGSS (SEQ ID NO: 306) | RASQDIGSSLN (SEQ ID NO: 305) |
| | VL CDR2 | ATSSLDS (SEQ ID NO: 379) | ATS (SEQ ID NO: 380) | ATSSLDS (SEQ ID NO: 379) |
| | VL CDR3 | LQYASSPYT (SEQ ID NO: 429) | LQYASSPYT (SEQ ID NO: 429) | LQYASSPYT (SEQ ID NO: 429) |

| | | Chothia | Contact | AbM |
|---|---|---|---|---|
| VH CDR Seq. | VH CDR1 | GYPFTIY (SEQ ID NO: 54) | TIYGMN (SEQ ID NO: 55) | GYPFTIYGMN (SEQ ID NO: 51) |
| | VH CDR2 | TYSG (SEQ ID NO: 144) | WMGWINTYSGVPT (SEQ ID NO: 145) | WINTYSGVPT (SEQ ID NO: 146) |
| | VH CDR3 | TGN (SEQ ID NO: 231) | ASATGN (SEQ ID NO: 232) | ATGNY (SEQ ID NO: 229) |
| VL CDR Seq. | VL CDR1 | SQDIGSS (SEQ ID NO: 307) | GSSLNWL (SEQ ID NO: 308) | RASQDIGSSLN (SEQ ID NO: 305) |
| | VL CDR2 | ATS (SEQ ID NO: 380) | RLIYATSSLD (SEQ ID NO: 381) | ATSSLDS (SEQ ID NO: 379) |
| | VL CDR3 | YASSPY (SEQ ID NO: 430) | LQYASSPY (SEQ ID NO: 431) | LQYASSPYT (SEQ ID NO: 429) |

VH Sequence: QIQLVQSGPELKKPGETVKISCKASGYPFTIYGMNWVEQAPGKGLKWMGWINTYSGVPTY-ADDFKGRFAFSLETSASTAYLQINNLKDEDTATYFCASATGNYWGQGTTLTVSS (SEQ ID NO: 5)
VL Sequence: DIQMTQSPSSLSASLGERVSLTCRASQDIGSSLNWLQQEPDGTIKRLIYATSSLDSGVP-KRFSGSRSGSDYSLTISSLESEDFVDYYCLQYASSPYTFGGGTKVEIK (SEQ ID NO: 6)

TABLE 4

Antibody 5F12 CDR Sequences

| | | Exemplary | IMGT | Kabat |
|---|---|---|---|---|
| VH CDR Seq. | VH CDR1 | GYTFTDYYIN (SEQ ID NO: 56) | GYTFTDYY (SEQ ID NO: 57) | DYYIN (SEQ ID NO: 58) |
| | VH CDR2 | RIYPGNGNTYHNE KFKG (SEQ ID NO: 147) | IYPGNGNT (SEQ ID NO: 148) | RIYPGNGNTYHNE KFKG (SEQ ID NO: 147) |
| | VH CDR3 | EGLYYDYDRYFDY (SEQ ID NO: 233) | AREGLYYDYDRYF DY (SEQ ID NO: 234) | EGLYYDYDRYFDY (SEQ ID NO: 233) |
| VL CDR Seq. | VL CDR1 | RASESVDTYGNSF MH (SEQ ID NO: 309) | ESVDTYGNSF (SEQ ID NO: 310) | RASESVDTYGNSF MH (SEQ ID NO: 309) |
| | VL CDR2 | LASNLES (SEQ ID NO: 382) | LAS (SEQ ID NO: 383) | LASNLES (SEQ ID NO: 382) |

TABLE 4-continued

Antibody 5F12 CDR Sequences

| | | | | |
|---|---|---|---|---|
| | VL CDR3 | HQNNEDPPA (SEQ ID NO: 432) | HQNNEDPPA (SEQ ID NO: 432) | HQNNEDPPA (SEQ ID NO: 432) |

| | | Chothia | Contact | AbM |
|---|---|---|---|---|
| VH CDR Seq. | VH CDR1 | GYTFTDY (SEQ ID NO: 49) | TDYYIN (SEQ ID NO: 59) | GYTFTDYYIN (SEQ ID NO: 56) |
| | VH CDR2 | PGNG (SEQ ID NO: 149) | WIARIYPGNGNTY (SEQ ID NO: 150) | RIYPGNGNTY (SEQ ID NO: 151) |
| | VH CDR3 | GLYYDYDRYFD (SEQ ID NO: 235) | AREGLYYDYDRYFD (SEQ ID NO: 236) | EGLYYDYDRYFDY (SEQ ID NO: 233) |
| VL CDR Seq. | VL CDR1 | SESVDTYGNSF (SEQ ID NO: 311) | DTYGNSFMHWY (SEQ ID NO: 312) | RASESVDTYGNSFMH (SEQ ID NO: 309) |
| | VL CDR2 | LAS (SEQ ID NO: 383) | LLIYLASNLE (SEQ ID NO: 384) | LASNLES (SEQ ID NO: 382) |
| | VL CDR3 | NNEDPP (SEQ ID NO: 433) | HQNNEDPP (SEQ ID NO: 434) | HQNNEDPPA (SEQ ID NO: 432) |

VH Sequence: QVQLKQSGTELVRPGASVKLSCKASGYTFTDYYINWVKQRPGQGLEWIARIYPGNGNTYH-NEKFKGKATLTAEKSSSTAYMQLSSLTEDSAVYFCAREGLYYDYDRYFDWGQGTALTVSS (SEQ ID NO: 7)
VL Sequence: NIVLTQSPASLAVSLGQRATISCRASESVDTYGNSFMHWYQQKPGQPPKLLIYLASNLES-GVPARFSGSGSRTDFTLTIDPVEADDAATYYCHQNNEDPPAFGGGTKLEIK (SEQ ID NO: 8)

TABLE 5

Antibody 5A20 CDR Sequences

| | | Exemplary | IMGT | Kabat |
|---|---|---|---|---|
| VH CDR Seq. | VH CDR1 | GYTFTDYWIE (SEQ ID NO: 60) | GYTFTDYW (SEQ ID NO: 61) | DYWIE (SEQ ID NO: 62) |
| | VH CDR2 | EILLGSDSIHFNEKFKG (SEQ ID NO: 152) | ILLGSDSI (SEQ ID NO: 153) | EILLGSDSIHFNEKFKG (SEQ ID NO: 152) |
| | VH CDR3 | QDWNWYFDV (SEQ ID NO: 237) | VRQDWNWYFDV (SEQ ID NO: 238) | QDWNWYFDV (SEQ ID NO: 237) |
| VL CDR Seq. | VL CDR1 | KSSQSLLDFDGKTYLN (SEQ ID NO: 313) | QSLLDFDGKTY (SEQ ID NO: 314) | KSSQSLLDFDGKTYLN (SEQ ID NO: 313) |
| | VL CDR2 | LVSKLDS (SEQ ID NO: 385) | LVS (SEQ ID NO: 386) | LVSKLDS (SEQ ID NO: 385) |
| | VL CDR3 | WQGTHFPRT (SEQ ID NO: 435) | WQGTHFPRT (SEQ ID NO: 435) | WQGTHFPRT (SEQ ID NO: 435) |

| | | Chothia | Contact | AbM |
|---|---|---|---|---|
| VH CDR Seq. | VH CDR1 | GYTFTDY (SEQ ID NO: 49) | TDYWIE (SEQ ID NO: 63) | GYTFTDYWIE (SEQ ID NO: 60) |
| | VH CDR2 | LGSD (SEQ ID NO: 154) | WIGEILLGSDSIH (SEQ ID NO: 155) | EILLGSDSIH (SEQ ID NO: 156) |
| | VH CDR3 | DWNWYFD (SEQ ID NO: 239) | VRQDWNWYFD (SEQ ID NO: 240) | QDWNWYFDV (SEQ ID NO: 237) |
| VL CDR Seq. | VL CDR1 | SQSLLDFDGKTY (SEQ ID NO: 315) | LDFDGKTYLNWY (SEQ ID NO: 316) | KSSQSLLDFDGKTYLN (SEQ ID NO: 313) |
| | VL CDR2 | LVS (SEQ ID NO: 386) | RLFYLVSKLD (SEQ ID NO: 387) | LVSKLDS (SEQ ID NO: 385) |
| | VL CDR3 | GTHFPR (SEQ ID NO: 436) | WQGTHFPR (SEQ ID NO: 437) | WQGTHFPRT (SEQ ID NO: 435) |

VH Sequence: QVQLQQSGPELMKPGASVILSCKAIGYTFTDYWIEWVKERPGHGLEWIGEILLGSDSIHF-NEKFKGKATISADTSSNTAYMQLSSLTTEDSAIYYCVRQDWNWYFDVWGTGTTVTVSS (SEQ ID NO: 9)
VL Sequence: DVVMTQTPLTLSVTIGHPASISCKSSQSLLDFDGKTYLNWFQRPGQSPKRLFYL-VSKLDSGVPDRFTGSGSGTDFTLKISRVEAEDLGVYYCWQGTHFPRTFGGGTKLEIK (SEQ ID NO: 10)

TABLE 6

Antibody 8D8 CDR Sequences

|  |  | Exemplary | IMGT | Kabat |
|---|---|---|---|---|
| VH CDR Seq. | VH CDR1 | GFSLSRYSVH (SEQ ID NO: 64) | GFSLSRYS (SEQ ID NO: 65) | RYSVH (SEQ ID NO: 66) |
|  | VH CDR2 | MIWGFGSTDYNSALKS (SEQ ID NO: 157) | IWGFGST (SEQ ID NO: 220) | MIWGFGSTDYNSALKS (SEQ ID NO: 157) |
|  | VH CDR3 | IHTTAGSY (SEQ ID NO: 241) | ARIHTTAGSY (SEQ ID NO: 242) | IHTTAGSY (SEQ ID NO: 241) |
| VL CDR Seq. | VL CDR1 | KASQNVGTNVA (SEQ ID NO: 317) | QNVGTN (SEQ ID NO: 318) | KASQNVGTNVA (SEQ ID NO: 317) |
|  | VL CDR2 | STSYRYS (SEQ ID NO: 388) | STS (SEQ ID NO: 389) | STSYRYS (SEQ ID NO: 388) |
|  | VL CDR3 | HQYNSYPLT (SEQ ID NO: 438) | HQYNSYPLT (SEQ ID NO: 438) | HQYNSYPLT (SEQ ID NO: 438) |

|  |  | Chothia | Contact | AbM |
|---|---|---|---|---|
| VH CDR Seq. | VH CDR1 | GFSLSRY (SEQ ID NO: 67) | SRYSVH (SEQ ID NO: 68) | GFSLSRYSVH (SEQ ID NO: 64) |
|  | VH CDR2 | GFG (SEQ ID NO: 158) | WLGMIWGFGSTD (SEQ ID NO: 159) | MIWGFGSTD (SEQ ID NO: 160) |
|  | VH CDR3 | HTTAGS (SEQ ID NO: 243) | ARIHTTAGS (SEQ ID NO: 244) | IHTTAGSY (SEQ ID NO: 241) |
| VL CDR Seq. | VL CDR1 | SQNVGTN (SEQ ID NO: 319) | GTNVAWY (SEQ ID NO: 320) | KASQNVGTNVA (SEQ ID NO: 317) |
|  | VL CDR2 | STS (SEQ ID NO: 389) | ALVYSTSYRY (SEQ ID NO: 390) | STSYRYS (SEQ ID NO: 388) |
|  | VL CDR3 | YNSYPL (SEQ ID NO: 439) | HQYNSYPL (SEQ ID NO: 440) | HQYNSYPLT (SEQ ID NO: 438) |

VH Sequence: QVQLKESGPGLVAPSQSLSITCTVSGFSLSRYSVHWVRQPPGKGLEWLGMIWGFGSTDYNSALKSRLSITKDNSKSQFFLKMNSLQTDDTAMYYCARIHTTAGSYWGQGTLVTVSA (SEQ ID NO: 11)
VL Sequence: DIVMTQSQKFMSTSIGDRVSVTCKASQNVGTNVAWYQQKPGQSPKALVYSTSYRYSGVPDRFTGSGSGTDFTLTISNVQSEDLAEYFCHQYNSYPLTFGAGTKLELK (SEQ ID NO: 12)

TABLE 7

Antibody 17J16 CDR Sequences

|  |  | Exemplary | IMGT | Kabat |
|---|---|---|---|---|
| VH CDR Seq. | VH CDR1 | GYTFTDYWIH (SEQ ID NO: 69) | GYTFTDYW (SEQ ID NO: 61) | DYWIH (SEQ ID NO: 70) |
|  | VH CDR2 | YINPNSNYAEYNQKFKV (SEQ ID NO: 161) | INPNSNYA (SEQ ID NO: 162) | YINPNSNYAEYNQKFKV (SEQ ID NO: 161) |
|  | VH CDR3 | FDWNWYFHV (SEQ ID NO: 245) | ARFDWNWYFHV (SEQ ID NO: 246) | FDWNWYFHV (SEQ ID NO: 245) |
| VL CDR Seq. | VL CDR1 | KSSQSLSDSDGKTYLN (SEQ ID NO: 321) | QSLSDSDGKTY (SEQ ID NO: 322) | KSSQSLSDSDGKTYLN (SEQ ID NO: 321) |
|  | VL CDR2 | LVSRLGS (SEQ ID NO: 391) | LVS (SEQ ID NO: 386) | LVSRLGS (SEQ ID NO: 391) |
|  | VL CDR3 | WQGTHFPQT (SEQ ID NO: 441) | WQGTHFPQT (SEQ ID NO: 441) | WQGTHFPQT (SEQ ID NO: 441) |

|  |  | Chothia | Contact | AbM |
|---|---|---|---|---|
| VH CDR Seq. | VH CDR1 | GYTFTDY (SEQ ID NO: 49) | TDYWIH (SEQ ID NO: 71) | GYTFTDYWIH (SEQ ID NO: 69) |
|  | VH CDR2 | PNSN (SEQ ID NO: 163) | WIGYINPNSNYAE (SEQ ID NO: 164) | YINPNSNYAE (SEQ ID NO: 165) |
|  | VH CDR3 | DWNWYFH (SEQ ID NO: 247) | ARFDWNWYFH (SEQ ID NO: 248) | FDWNWYFHV (SEQ ID NO: 245) |
| VL CDR Seq. | VL CDR1 | SQSLSDSDGKTY (SEQ ID NO: 323) | SDSDGKTYLNWL (SEQ ID NO: 324) | KSSQSLSDSDGKT YLN (SEQ ID NO: 321) |
|  | VL CDR2 | LVS (SEQ ID NO: 386) | RLIYLVSRLG (SEQ ID NO: 392) | LVSRLGS (SEQ ID NO: 391) |

TABLE 7-continued

Antibody 17J16 CDR Sequences

| | | | |
|---|---|---|---|
| VL CDR3 | GTHFPQ<br>(SEQ ID NO: 442) | WQGTHFPQ<br>(SEQ ID NO: 443) | WQGTHFPQT<br>(SEQ ID NO: 441) |

VH Sequence: QVQLQQSGAELAKPGASVKMSCKTSGYTFTDYWIHWVKQRPGQGLEWIGYINPNSNY-AEYNQKFKVKATLTADKSSSTAYLQLSRLTSEDSAVYYCARFDWNWYFHVWGAGSTVTVSS (SEQ ID NO: 13)
VL Sequence: DVALTQIPLTLSVTVGQPASISCKSSQSLSDSDGKTYLNWLLQKPGQSPKRLIYLVSR-LGSGVPDRFTGSGSGADFTLKISRVEAEDLGVYYCWQGTHFPQTFGGGTKLEIK (SEQ ID NO: 14)

TABLE 8

Antibody 25M22 CDR Sequences

| | | Exemplary | IMGT | Kabat |
|---|---|---|---|---|
| VH CDR Seq. | VH CDR1 | GYTFTSYWVN<br>(SEQ ID NO: 72) | GYTFTSYW<br>(SEQ ID NO: 73) | SYWVN<br>(SEQ ID NO: 74) |
| | VH CDR2 | RIYPGDGDTNYNG<br>KFKG<br>(SEQ ID NO: 166) | IYPGDGDT<br>(SEQ ID NO: 167) | RIYPGDGDTNYNG<br>KFKG<br>(SEQ ID NO: 166) |
| | VH CDR3 | AYLLRLRRTGYYA<br>MDY<br>(SEQ ID NO: 249) | ARAYLLRLRRTGY<br>YAMDY<br>(SEQ ID NO: 250) | AYLLRLRRTGYYA<br>MDY<br>(SEQ ID NO: 249) |
| VL CDR Seq. | VL CDR1 | KSTKSLLNSDEFT<br>YLD<br>(SEQ ID NO: 325) | KSLLNSDEFTY<br>(SEQ ID NO: 326) | KSTKSLLNSDEFT<br>YLD<br>(SEQ ID NO: 325) |
| | VL CDR2 | LVSNRFS<br>(SEQ ID NO: 393) | LVS<br>(SEQ ID NO: 386) | LVSNRFS<br>(SEQ ID NO: 393) |
| | VL CDR3 | FQSNYLPYT<br>(SEQ ID NO: 444) | FQSNYLPYT<br>(SEQ ID NO: 444) | FQSNYLPYT<br>(SEQ ID NO: 444) |

| | | Chothia | Contact | AbM |
|---|---|---|---|---|
| VH CDR Seq. | VH CDR1 | GYTFTSY<br>(SEQ ID NO: 75) | TSYWVN<br>(SEQ ID NO: 76) | GYTFTSYWVN<br>(SEQ ID NO: 72) |
| | VH CDR2 | PGDG<br>(SEQ ID NO: 168) | WIGRIYPGDGDTN<br>(SEQ ID NO: 169) | RIYPGDGDTN<br>(SEQ ID NO: 170) |
| | VH CDR3 | YLLRLRRTGYYAMD<br>(SEQ ID NO: 251) | ARAYLLRLRRTGY<br>YAMD<br>(SEQ ID NO: 252) | AYLLRLRRTGYYA<br>MDY<br>(SEQ ID NO: 249) |
| VL CDR Seq. | VL CDR1 | TKSLLNSDEFTY<br>(SEQ ID NO: 327) | LNSDEFTYLDWY<br>(SEQ ID NO: 328) | KSTKSLLNSDEFT<br>YLD<br>(SEQ ID NO: 325) |
| | VL CDR2 | LVS<br>(SEQ ID NO: 386) | LLIFLVSNRF<br>(SEQ ID NO: 394) | LVSNRFS<br>(SEQ ID NO: 393) |
| | VL CDR3 | SNYLPY<br>(SEQ ID NO: 445) | FQSNYLPY<br>(SEQ ID NO: 446) | FQSNYLPYT<br>(SEQ ID NO: 444) |

VH Sequence: QVQLQQSGPDLVKPGASVKISCKASGYTFTSYWVNWMKQRPGKGLEWIGRIYPGDGDT-NYNGKFKGKATLTADKSSSTAYMQLSSLTSEDSAVYFCARAYLLRLRRTGYYAMDYWGQGTSVTVSS (SEQ ID NO: 15)
VL Sequence: DVVLTQTPLSLPVNIGDQASISCKSTKSLLNSDEFTYLDWYLQKPGQSPQLLIFLVSNRF-SGVPDRFSGSGSGTDFTLKISRVEAEDLGVYYCFQSNYLPYTFGGGTKLEIK (SEQ ID NO: 16)

TABLE 9

Antibody 2B8 CDR Sequences

| | | Exemplary | IMGT | Kabat |
|---|---|---|---|---|
| VH CDR Seq. | VH CDR1 | GYTFTTYGMS<br>(SEQ ID NO: 77) | GYTFTTYG<br>(SEQ ID NO: 78) | TYGMS<br>(SEQ ID NO: 79) |
| | VH CDR2 | WINTYSGVPTFVD<br>DFRG<br>(SEQ ID NO: 171) | INTYSGVP<br>(SEQ ID NO: 143) | WINTYSGVPTFVD<br>DFRG<br>(SEQ ID NO: 171) |
| | VH CDR3 | RSSYYPYWYFDV<br>(SEQ ID NO: 253) | ARRSSYYPYWYF<br>DV<br>(SEQ ID NO: 254) | RSSYYPYWYFDV<br>(SEQ ID NO: 253) |
| VL CDR Seq. | VL CDR1 | RPSENIYSYLT<br>(SEQ ID NO: 329) | ENIYSY<br>(SEQ ID NO: 330) | RPSENIYSYLT<br>(SEQ ID NO: 329) |
| | VL CDR2 | NAQTLAE<br>(SEQ ID NO: 395) | NAQ<br>(SEQ ID NO: 396) | NAQTLAE<br>(SEQ ID NO: 395) |
| | VL CDR3 | QHYYGYPFT<br>(SEQ ID NO: 447) | QHYYGYPFT<br>(SEQ ID NO: 447) | QHYYGYPFT<br>(SEQ ID NO: 447) |

TABLE 9-continued

Antibody 2B8 CDR Sequences

|  |  | Chothia | Contact | AbM |
|---|---|---|---|---|
| VH CDR Seq. | VH CDR1 | GYTFTTY (SEQ ID NO: 80) | TTYGMS (SEQ ID NO: 81) | GYTFTTYGMS (SEQ ID NO: 77) |
|  | VH CDR2 | TYSG (SEQ ID NO: 144) | WMGWINTYSGVPT (SEQ ID NO: 145) | WINTYSGVPT (SEQ ID NO: 146) |
|  | VH CDR3 | SSYYPYWYFD (SEQ ID NO: 255) | ARRSSYYPYWYFD (SEQ ID NO: 256) | RSSYYPYWYFDV (SEQ ID NO: 253) |
| VL CDR Seq. | VL CDR1 | SENIYSY (SEQ ID NO: 331) | YSYLTWF (SEQ ID NO: 332) | RPSENIYSYLT (SEQ ID NO: 329) |
|  | VL CDR2 | NAQ (SEQ ID NO: 396) | LLVYNAQTLA (SEQ ID NO: 397) | NAQTLAE (SEQ ID NO: 395) |
|  | VL CDR3 | YYGYPF (SEQ ID NO: 448) | QHYYGYPF (SEQ ID NO: 449) | QHYYGYPFT (SEQ ID NO: 447) |

VH Sequence: QIQLVQSGPELKKPGETVKISCKASGYTFTTYGMSWVKQAPGKIFKWMGWINTYSGVPT-FVDDFRGRFAFSLETSASTAYLQIGNLKNEDTATYFCARRSSYYPYWYFDVWGTGTTVTVSS (SEQ ID NO: 17)
VL Sequence: DIQMTQSPASLSASVGETVTITCRPSENIYSYLTWFQQEQGKSPQLLVYNAQTLAE-GVPSRFSGSGSGTHFSLKINSLQPEDFGTYYCQHYYGYPFTFGSGTKLEIK (SEQ ID NO: 18)

TABLE 10

Antibody 22N5 CDR Sequences

|  |  | Exemplary | IMGT | Kabat |
|---|---|---|---|---|
| VH CDR Seq. | VH CDR1 | GYTFTDYSMH (SEQ ID NO: 82) | GYTFTDYS (SEQ ID NO: 83) | DYSMH (SEQ ID NO: 84) |
|  | VH CDR2 | WINTETGEPTYAD DFKG (SEQ ID NO: 172) | INTETGEP (SEQ ID NO: 173) | WINTETGEPTYAD DFKG (SEQ ID NO: 172) |
|  | VH CDR3 | GTLNY (SEQ ID NO: 257) | VKGTLNY (SEQ ID NO: 258) | GTLNY (SEQ ID NO: 257) |
| VL CDR Seq. | VL CDR1 | KASQDIKSYLN (SEQ ID NO: 333) | QDIKSY (SEQ ID NO: 334) | KASQDIKSYLN (SEQ ID NO: 333) |
|  | VL CDR2 | RTKRLVD (SEQ ID NO: 398) | RTK (SEQ ID NO: 399) | RTKRLVD (SEQ ID NO: 398) |
|  | VL CDR3 | LQYVEFPLT (SEQ ID NO: 450) | LQYVEFPLT (SEQ ID NO: 450) | LQYVEFPLT (SEQ ID NO: 450) |

|  |  | Chothia | Contact | AbM |
|---|---|---|---|---|
| VH CDR Seq. | VH CDR1 | GYTFTDY (SEQ ID NO: 49) | TDYSMH (SEQ ID NO: 85) | GYTFTDYSMH (SEQ ID NO: 82) |
|  | VH CDR2 | TETG (SEQ ID NO: 174) | WMGWINTETGEPT (SEQ ID NO: 175) | WINTETGEPT (SEQ ID NO: 176) |
|  | VH CDR3 | TLN (SEQ ID NO: 259) | VKGTLN (SEQ ID NO: 260) | GTLNY (SEQ ID NO: 257) |
| VL CDR Seq. | VL CDR1 | SQDIKSY (SEQ ID NO: 335) | KSYLNWF (SEQ ID NO: 336) | KASQDIKSYLN (SEQ ID NO: 333) |
|  | VL CDR2 | RTK (SEQ ID NO: 399) | TLIYRTKRLV (SEQ ID NO: 400) | RTKRLVD (SEQ ID NO: 398) |
|  | VL CDR3 | YVEFPL (SEQ ID NO: 451) | LQYVEFPL (SEQ ID NO: 452) | LQYVEFPLT (SEQ ID NO: 450) |

VH Sequence: QNQLVQSGPELKKPGEIVKISCKTSGYTFTDYSMHWVKKTPGKGFKWMGWINTETGEPTY-ADDFKGRFAFSLETSANTAHLQITNLKNEDTATYFCVKGTLNYWGQGTTLTVSS (SEQ ID NO: 19)
VL Sequence: DIKMTQSPSSMYASLGERVTITCKASQDIKSYLNWFQQKPGKSPKTLIYRT-KRLVDGVPSRFSGSGSGQDYSLTVSSLEYDDVGIYYCLQYVEFPLTFGDGTKLELK (SEQ ID NO: 20)

TABLE 11

Antibody 2I23 CDR Sequences

|  |  | Exemplary | IMGT | Kabat |
|---|---|---|---|---|
| VH CDR Seq. | VH CDR1 | GYSFTSYNID (SEQ ID NO: 86) | GYSFTSYN (SEQ ID NO: 87) | SYNID (SEQ ID NO: 88) |
|  | VH CDR2 | WIFPGDGST (SEQ ID NO: 177) | IFPGDGST (SEQ ID NO: 178) | WIFPGDGSTKYNE KFKG (SEQ ID NO: 179) |
|  | VH CDR3 | SGIYYGSHFVY (SEQ ID NO: 261) | ARSGIYYGSHFVY (SEQ ID NO: 262) | SGIYYGSHFVY (SEQ ID NO: 261) |

TABLE 11-continued

Antibody 2I23 CDR Sequences

| | | | | |
|---|---|---|---|---|
| VL CDR Seq. | VL CDR1 | RSSQSLLDSDGKTYLN (SEQ ID NO: 337) | QSLLDSDGKTY (SEQ ID NO: 338) | RSSQSLLDSDGKTYLN (SEQ ID NO: 337) |
| | VL CDR2 | LVSKVDS (SEQ ID NO: 401) | LVS (SEQ ID NO: 386) | LVSKVDS (SEQ ID NO: 401) |
| | VL CDR3 | WQGTHFPLT (SEQ ID NO: 453) | WQGTHFPLT (SEQ ID NO: 453) | WQGTHFPLT (SEQ ID NO: 453) |

| | | Chothia | Contact | AbM |
|---|---|---|---|---|
| VH CDR Seq. | VH CDR1 | GYSFTSY (SEQ ID NO: 89) | TSYNID (SEQ ID NO: 90) | GYSFTSYNID (SEQ ID NO: 86) |
| | VH CDR2 | PGDG (SEQ ID NO: 168) | WIGWIFPGDGSTK (SEQ ID NO: 180) | WIFPGDGSTK (SEQ ID NO: 181) |
| | VH CDR3 | GIYYGSHFV (SEQ ID NO: 263) | ARSGIYYGSHFV (SEQ ID NO: 264) | SGIYYGSHFVY (SEQ ID NO: 261) |
| VL CDR Seq. | VL CDR1 | SQSLLDSDGKTY (SEQ ID NO: 339) | LDSDGKTYLNWL (SEQ ID NO: 340) | RSSQSLLDSDGKTYLN (SEQ ID NO: 337) |
| | VL CDR2 | LVS (SEQ ID NO: 386) | RLIYLVSKVD (SEQ ID NO: 402) | LVSKVDS (SEQ ID NO: 401) |
| | VL CDR3 | GTHFPL (SEQ ID NO: 454) | WQGTHFPL (SEQ ID NO: 455) | WQGTHFPLT (SEQ ID NO: 453) |

VH Sequence: QAQLQQSGAELVKPGASVKLSCKASGYSFTSYNIDWVRQRPEQGLEWIGWIFPGDGSTKYNEKFKGQATLTTDKSSSTTYIHLSRLTSEDSAVYFCARSGIYYGSHFVYWGQGTLVTVSA (SEQ ID NO: 21)

VL Sequence: DVVMTQTPLTLSVTIGQSASISCRSSQSLLDSDGKTYLNWLLQRPGQSPKRLIYLVSKVDSGVPDRFTGSGSGTDFTLKISRVEAEDLGVYFCWQGTHFPLTFGAGTKLELK (SEQ ID NO: 22)

TABLE 12

Antibody 6N16 CDR Sequences

| | | Exemplary | IMGT | Kabat |
|---|---|---|---|---|
| VH CDR Seq. | VH CDR1 | GYTFTSYNIN (SEQ ID NO: 91) | GYTFTSYN (SEQ ID NO: 92) | SYNIN (SEQ ID NO: 93) |
| | VH CDR2 | WIFPGDDSIKYNENFRG (SEQ ID NO: 182) | IFPGDDSI (SEQ ID NO: 183) | WIFPGDDSIKYNENFRG (SEQ ID NO: 182) |
| | VH CDR3 | SGIFYGNNFAY (SEQ ID NO: 265) | ARSGIFYGNNFAY (SEQ ID NO: 266) | SGIFYGNNFAY (SEQ ID NO: 265) |
| VL CDR Seq. | VL CDR1 | KSSQSLLDGDGETYLS (SEQ ID NO: 341) | QSLLDGDGETY (SEQ ID NO: 342) | KSSQSLLDGDGETYLS (SEQ ID NO: 341) |
| | VL CDR2 | LVSKLDS (SEQ ID NO: 385) | LVS (SEQ ID NO: 386) | LVSKLDS (SEQ ID NO: 385) |
| | VL CDR3 | CQSTHFPLT (SEQ ID NO: 456) | CQSTHFPLT (SEQ ID NO: 456) | CQSTHFPLT (SEQ ID NO: 456) |

| | | Chothia | Contact | AbM |
|---|---|---|---|---|
| VH CDR Seq. | VH CDR1 | GYTFTSY (SEQ ID NO: 75) | TSYNIN (SEQ ID NO: 94) | GYTFTSYNIN (SEQ ID NO: 91) |
| | VH CDR2 | PGDD (SEQ ID NO: 184) | WIGWIFPGDDSIK (SEQ ID NO: 185) | WIFPGDDSIK (SEQ ID NO: 186) |
| | VH CDR3 | GIFYGNNFA (SEQ ID NO: 267) | ARSGIFYGNNFA (SEQ ID NO: 268) | SGIFYGNNFAY (SEQ ID NO: 265) |
| VL CDR Seq. | VL CDR1 | SQSLLDGDGETY (SEQ ID NO: 343) | LDGDGETYLSWL (SEQ ID NO: 344) | KSSQSLLDGDGETYLS (SEQ ID NO: 341) |
| | VL CDR2 | LVS (SEQ ID NO: 386) | RLIYLVSKLD (SEQ ID NO: 403) | LVSKLDS (SEQ ID NO: 385) |
| | VL CDR3 | STHFPL (SEQ ID NO: 457) | CQSTHFPL (SEQ ID NO: 458) | CQSTHFPLT (SEQ ID NO: 456) |

VH Sequence: QVQLQQSGSELVKPGTSMKLSCKASGYTFTSYNINWVRLRPEQGLEWIGWIFPGDDSIKYNENFRGKATLTTDKSSSTAYMHLSRLTSDDSAVYFCARSGIFYGNNFAYWGQGTLVTVSA (SEQ ID NO: 23)

VL Sequence: DVVMTQAPLILSVTIGQPASISCKSSQSLLDGDGETYLSWLLQRPGQSPKRLIYLVSKLDSGVPDRFTGSGSGTDFTLKISRVEAEDLGVYYCCQSTHFPLTFGAGTKLELK (SEQ ID NO: 24)

TABLE 13

Antibody 1B3 CDR Sequences

|  |  | Exemplary | IMGT | Kabat |
|---|---|---|---|---|
| VH CDR Seq. | VH CDR1 | GFTFTGYNIN (SEQ ID NO: 95) | GFTFTGYN (SEQ ID NO: 96) | GYNIN (SEQ ID NO: 97) |
|  | VH CDR2 | WIFPGDDNAKYNE KFKG (SEQ ID NO: 187) | IPPGDDNA (SEQ ID NO: 188) | WIFPGDDNAKYNE KFKG (SEQ ID NO: 187) |
|  | VH CDR3 | TPVLSNYFDY (SEQ ID NO: 269) | ARTPVLSNYFDY (SEQ ID NO: 270) | TPVLSNYFDY (SEQ ID NO: 269) |
| VL CDR Seq. | VL CDR1 | KASQDISKYIS (SEQ ID NO: 345) | QDISKY (SEQ ID NO: 346) | KASQDISKYIS (SEQ ID NO: 345) |
|  | VL CDR2 | YTSTLQP (SEQ ID NO: 404) | YTS (SEQ ID NO: 405) | YTSTLQP (SEQ ID NO: 404) |
|  | VL CDR3 | LQYDNLYT (SEQ ID NO: 459) | LQYDNLYT (SEQ ID NO: 459) | LQYDNLYT (SEQ ID NO: 459) |

|  |  | Chothia | Contact | AbM |
|---|---|---|---|---|
| VH CDR Seq. | VH CDR1 | GFTFTGY (SEQ ID NO: 98) | TGYNIN (SEQ ID NO: 99) | GFTFTGYNIN (SEQ ID NO: 95) |
|  | VH CDR2 | PGDD (SEQ ID NO: 184) | WIGWIFPGDDNAK (SEQ ID NO: 189) | WIFPGDDNAK (SEQ ID NO: 190) |
|  | VH CDR3 | PVLSNYFD (SEQ ID NO: 271) | ARTPVLSNYFD (SEQ ID NO: 272) | TPVLSNYFDY (SEQ ID NO: 269) |
| VL CDR Seq. | VL CDR1 | SQDISKY (SEQ ID NO: 347) | SKYISWY (SEQ ID NO: 348) | KASQDISKYIS (SEQ ID NO: 345) |
|  | VL CDR2 | YTS (SEQ ID NO: 405) | LLIHYTSTLQ (SEQ ID NO: 406) | YTSTLQP (SEQ ID NO: 404) |
|  | VL CDR3 | YDNLY (SEQ ID NO: 460) | LQYDNLY (SEQ ID NO: 461) | LQYDNLYT (SEQ ID NO: 459) |

VH Sequence: QVHLQQPGAELVKPGASVKLSCKASGFTFTGYNINWVRLRPEQGLEWIGWIF-PGDDNAKYNEKFKGKATLTTDKSSNTAYMQLSRLTSEDSAVYFCARTPVLSNYFDYWGQGTTLTVSS (SEQ ID NO: 25)
VL Sequence: DIQMTQSPSSLSASLGGKVTITCKASQDISKYISWYQHKPGKSPRLLIHYTSTLQP-GIPSRFSGSGSGRDYSFSISNLEPEDIATYYCLQYDNLYTFGGGTKLEIK (SEQ ID NO: 26)

TABLE 14

Antibody 19K19 CDR Sequences

|  |  | Exemplary | IMGT | Kabat |
|---|---|---|---|---|
| VH CDR Seq. | VH CDR1 | GYAFTSYWMN (SEQ ID NO: 100) | GYAFTSYW (SEQ ID NO: 101) | SYWMN (SEQ ID NO: 102) |
|  | VH CDR2 | RIYPGDGDTNYNG KFKG (SEQ ID NO: 166) | IYPGDGDT (SEQ ID NO: 167) | RIYPGDGDTNYNG KFKG (SEQ ID NO: 166) |
|  | VH CDR3 | AYLLRLRRTGYYA MDY (SEQ ID NO: 249) | ARAYLLRLRRTGY YAMDY (SEQ ID NO: 250) | AYLLRLRRTGYYA MDY (SEQ ID NO: 249) |
| VL CDR Seq. | VL CDR1 | KSTKSLLNSDEFT YLD (SEQ ID NO: 325) | KSLLNSDEFTY (SEQ ID NO: 326) | KSTKSLLNSDEFT YLD (SEQ ID NO: 325) |
|  | VL CDR2 | LVSNRFS (SEQ ID NO: 393) | LVS (SEQ ID NO: 386) | LVSNRFS (SEQ ID NO: 393) |
|  | VL CDR3 | FQSNYLPYT (SEQ ID NO: 444) | FQSNYLPYT (SEQ ID NO: 444) | FQSNYLPYT (SEQ ID NO: 444) |

|  |  | Chothia | Contact | AbM |
|---|---|---|---|---|
| VH CDR Seq. | VH CDR1 | GYAFTSY (SEQ ID NO: 103) | TSYWMN (SEQ ID NO: 104) | GYAFTSYWMN (SEQ ID NO: 100) |
|  | VH CDR2 | PGDG (SEQ ID NO: 168) | WIGRIYPGDGDTN (SEQ ID NO: 169) | RIYPGDGDTN (SEQ ID NO: 170) |
|  | VH CDR3 | YLLRLRRTGYYAMD (SEQ ID NO: 251) | ARAYLLRLRRTGY YAMD (SEQ ID NO: 252) | AYLLRLRRTGYYA MDY (SEQ ID NO: 249) |
| VL CDR Seq. | VL CDR1 | TKSLLNSDEFTY (SEQ ID NO: 327) | LNSDEFTYLDWY (SEQ ID NO: 328) | KSTKSLLNSDEFT YLD (SEQ ID NO: 325) |
|  | VL CDR2 | LVS (SEQ ID NO: 386) | LLIYLVSNRF (SEQ ID NO: 407) | LVSNRFS (SEQ ID NO: 393) |

TABLE 14-continued

Antibody 19K19 CDR Sequences

| | | | |
|---|---|---|---|
| VL CDR3 | SNYLPY | FQSNYLPY | FQSNYLPYT |
| | (SEQ ID NO: 445) | (SEQ ID NO: 446) | (SEQ ID NO: 444) |

VH Sequence: QVQLQQSGPDLVKPGASVKISCKASGYAFTSYWMNWVKQRPGKGLEWIGRIYPGDGT-NYNGKFKGKATLTADKSSSTAYMQLSSLTSEDSAVYFCARAYLLRLRRTGYYAMDYWGQGTSVTVSS (SEQ ID NO: 27)

VL Sequence: DVVLTQTPLSLPVNIGDQASISCKSTKSLLNSDEFTYLDWYLQKPGQSPQLLIYLVSNRF-SGVPDRFSGSGSGTDFTLKISRVEAEDLGVYYCFQSNYLPYTFGGGTKLEIK (SEQ ID NO: 28)

TABLE 15

Antibody 2B3 CDR Sequences

| | | Exemplary | IMGT | Kabat |
|---|---|---|---|---|
| VH CDR Seq. | VH CDR1 | GFTFSDYFMF | GFTFSDYF | DYFMF |
| | | (SEQ ID NO: 105) | (SEQ ID NO: 106) | (SEQ ID NO: 107) |
| | VH CDR2 | YISNDGDSTYYPD TVQG | ISNDGDST | YISNDGDSTYYPD TVQG |
| | | (SEQ ID NO: 191) | (SEQ ID NO: 192) | (SEQ ID NO: 191) |
| | VH CDR3 | QGAQATLDY | TRQGAQATLDY | QGAQATLDY |
| | | (SEQ ID NO: 273) | (SEQ ID NO: 274) | (SEQ ID NO: 273) |
| VL CDR Seq. | VL CDR1 | SASSSVFYMH | SSVFY | SASSSVFYMH |
| | | (SEQ ID NO: 349) | (SEQ ID NO: 350) | (SEQ ID NO: 349) |
| | VL CDR2 | STSNLAS | STS | STSNLAS |
| | | (SEQ ID NO: 408) | (SEQ ID NO: 389) | (SEQ ID NO: 408) |
| | VL CDR3 | HQWSST | HQWSST | HQWSST |
| | | (SEQ ID NO: 462) | (SEQ ID NO: 462) | (SEQ ID NO: 462) |

| | | Chothia | Contact | AbM |
|---|---|---|---|---|
| VH CDR Seq. | VH CDR1 | GFTFSDY | SDYFMF | GFTFSDYFMF |
| | | (SEQ ID NO: 108) | (SEQ ID NO: 109) | (SEQ ID NO: 105) |
| | VH CDR2 | NDGD | WVAYISNDGDSTY | YISNDGDSTY |
| | | (SEQ ID NO: 193) | (SEQ ID NO: 194) | (SEQ ID NO: 195) |
| | VH CDR3 | GAQATLD | TRQGAQATLD | QGAQATLDY |
| | | (SEQ ID NO: 275) | (SEQ ID NO: 276) | (SEQ ID NO: 273) |
| VL CDR Seq. | VL CDR1 | SSSVFY | FYMHWY | SASSSVFYMH |
| | | (SEQ ID NO: 351) | (SEQ ID NO: 352) | (SEQ ID NO: 349) |
| | VL CDR2 | STS | LLIYSTSNLA | STSNLAS |
| | | (SEQ ID NO: 389) | (SEQ ID NO: 409) | (SEQ ID NO: 408) |
| | VL CDR3 | WSS | HQWSS | HQWSST |
| | | (SEQ ID NO: 463) | (SEQ ID NO: 464) | (SEQ ID NO: 462) |

VH Sequence: EVKLVESGGGLVQPGGSLKLSCAASGFTFSDYFMFWVRQTPEKRLEWVAYISNDGD-STYYPDTVQGRFTISRDNAKNTLYLQMSRLRSEDTAMYYCTRQGAQATLDYWGQGTTLTVSS (SEQ ID NO: 29)

VL Sequence: QIVLTQSPAIMSASLGEEITLTCSASSSVFYMHWYQQKSGTSPKLLIYSTSNLAS-GIPSRFSGSGSGTFYSLTISSVEAEDAADYYCHQWSSTFGGGTKLEIK (SEQ ID NO: 30)

TABLE 16

Antibody 8C10 CDR Sequences

| | | Exemplary | IMGT | Kabat |
|---|---|---|---|---|
| VH CDR Seq. | VH CDR1 | GYTFANYGLT | GYTFANYG | NYGLT |
| | | (SEQ ID NO: 110) | (SEQ ID NO: 111) | (SEQ ID NO: 112) |
| | VH CDR2 | EIYPGSGHTHYNE DFKG | IYPGSGHT | EIYPGSGHTHYNE DFKG |
| | | (SEQ ID NO: 196) | (SEQ ID NO: 197) | (SEQ ID NO: 196) |
| | VH CDR3 | RIQLLLPVGGFVY | ARRIQLLLPVGGF VY | RIQLLLPVGGFVY |
| | | (SEQ ID NO: 277) | (SEQ ID NO: 278) | (SEQ ID NO: 277) |
| VL CDR Seq. | VL CDR1 | RASQSISNNLH | QSISNN | RASQSISNNLH |
| | | (SEQ ID NO: 353) | (SEQ ID NO: 354) | (SEQ ID NO: 353) |
| | VL CDR2 | YASQSIS | YAS | YASQSIS |
| | | (SEQ ID NO: 410) | (SEQ ID NO: 411) | (SEQ ID NO: 410) |
| | VL CDR3 | QQSNSWPHT | QQSNSWPHT | QQSNSWPHT |
| | | (SEQ ID NO: 465) | (SEQ ID NO: 465) | (SEQ ID NO: 465) |

TABLE 16-continued

Antibody 8C10 CDR Sequences

|  | Chothia | Contact | AbM |
|---|---|---|---|
| VH CDR Seq. VH CDR1 | GYTFANY (SEQ ID NO: 113) | ANYGLT (SEQ ID NO: 114) | GYTFANYGLT (SEQ ID NO: 110) |
| VH CDR2 | PGSG (SEQ ID NO: 198) | WIGEIYPGSGHTH (SEQ ID NO: 199) | EIYPGSGHTH (SEQ ID NO: 200) |
| VH CDR3 | IQLLLPVGGFV (SEQ ID NO: 279) | ARRIQLLLPVGGFV (SEQ ID NO: 280) | RIQLLLPVGGFVY (SEQ ID NO: 277) |
| VL CDR Seq. VL CDR1 | SQSISNN (SEQ ID NO: 355) | SNNLHWY (SEQ ID NO: 356) | RASQSISNNLH (SEQ ID NO: 353) |
| VL CDR2 | YAS (SEQ ID NO: 411) | LLIKYASQSI (SEQ ID NO: 412) | YASQSIS (SEQ ID NO: 410) |
| VL CDR3 | SNSWPH (SEQ ID NO: 466) | QQSNSWPH (SEQ ID NO: 467) | QQSNSWPHT (SEQ ID NO: 465) |

VH Sequence: QVQLQQSGVELARPGAAVKLSCKASGYTFANYGLTWVKQRTGQGLEWIGEIYPGS-GHTHYNEDFKGKATLTADRSSSTAYMELRSLTSEDSAVYFCARRIQLLLPVGGFVYWGQGTLVTVSA (SEQ ID NO: 31)
VL Sequence: DFVLTQSPATLSVTPGDSVSLSCRASQSISNNLHWYQQKSHESPRLLIKYASQSIS-GIPSRFSGSGSGTDFTLSINSVETEDFGVYFCQQSNSWPHTFGGGTKLEIK (SEQ ID NO: 32)

TABLE 17

Antibody 2A9 CDR Sequences

|  | Exemplary | IMGT | Kabat |
|---|---|---|---|
| VH CDR Seq. VH CDR1 | GFTFSTYAMS (SEQ ID NO: 115) | GFTFSTYA (SEQ ID NO: 116) | TYAMS (SEQ ID NO: 117) |
| VH CDR2 | SITSGGTTYYTDSVKG (SEQ ID NO: 201) | ITSGGTT (SEQ ID NO: 202) | SITSGGTTYYTDSVKG (SEQ ID NO: 201) |
| VH CDR3 | DGNFYYYGMDY (SEQ ID NO: 281) | ARDGNFYYYGMDY (SEQ ID NO: 282) | DGNFYYYGMDY (SEQ ID NO: 281) |
| VL CDR Seq. VL CDR1 | KASQNVGTAVA (SEQ ID NO: 357) | QNVGTA (SEQ ID NO: 358) | KASQNVGTAVA (SEQ ID NO: 357) |
| VL CDR2 | SASNRFT (SEQ ID NO: 413) | SAS (SEQ ID NO: 414) | SASNRFT (SEQ ID NO: 413) |
| VL CDR3 | QQYSSYFT (SEQ ID NO: 468) | QQYSSYFT (SEQ ID NO: 468) | QQYSSYFT (SEQ ID NO: 468) |

|  | Chothia | Contact | AbM |
|---|---|---|---|
| VH CDR Seq. VH CDR1 | GFTFSTY (SEQ ID NO: 118) | STYAMS (SEQ ID NO: 119) | GFTFSTYAMS (SEQ ID NO: 115) |
| VH CDR2 | SGG (SEQ ID NO: 134) | WVASITSGGTTY (SEQ ID NO: 203) | SITSGGTTY (SEQ ID NO: 204) |
| VH CDR3 | GNFYYYGMD (SEQ ID NO: 283) | ARDGNFYYYGMD (SEQ ID NO: 284) | DGNFYYYGMDY (SEQ ID NO: 281) |
| VL CDR Seq. VL CDR1 | SQNVGTA (SEQ ID NO: 359) | GTAVAWY (SEQ ID NO: 360) | KASQNVGTAVA (SEQ ID NO: 357) |
| VL CDR2 | SAS (SEQ ID NO: 414) | ILIYSASNRF (SEQ ID NO: 415) | SASNRFT (SEQ ID NO: 413) |
| VL CDR3 | YSSYF (SEQ ID NO: 469) | QQYSSYF (SEQ ID NO: 470) | QQYSSYFT (SEQ ID NO: 468) |

VH Sequence: EVKLVESGGGLVKPGGSLKLSCAASGFTFSTYAMSWVRQTPEKRLEWVASITSGGT-TYYTDSVKGRFTISRDNARNILYLQMSSLRSEDTAMYYCARDGNFYYYGMDYWGQGTSVTVSS (SEQ ID NO: 33)
VL Sequence: DIVMTQSQKFMSTSVGDRVSITCKASQNVGTAVAWYQQKPGQSPKILIYSASNRFTGVP-DRFTGSGSGTDFTLTISNMQSEDLADYFCQQYSSYFTFGGGTKLELK (SEQ ID NO: 34)

TABLE 18

Antibody 24G2 CDR Sequences

|  | Exemplary | IMGT | Kabat |
|---|---|---|---|
| VH CDR Seq. VH CDR1 | GYTFTTYWMH (SEQ ID NO: 120) | GYTFTTYW (SEQ ID NO: 121) | TYWMH (SEQ ID NO: 122) |
| VH CDR2 | MIHPNSGSSNYNEKFKN (SEQ ID NO: 205) | IHPNSGSS (SEQ ID NO: 206) | MIHPNSGSSNYNEKFKN (SEQ ID NO: 205) |
| VH CDR3 | SDYGFIPYFDY (SEQ ID NO: 285) | ARSDYGFIPYFDY (SEQ ID NO: 286) | SDYGFIPYFDY (SEQ ID NO: 285) |

TABLE 18-continued

Antibody 24G2 CDR Sequences

| VL CDR Seq. | | | | |
|---|---|---|---|---|
| | VL CDR1 | RASQSIGTSIH (SEQ ID NO: 361) | QSIGTS (SEQ ID NO: 362) | RASQSIGTSIH (SEQ ID NO: 361) |
| | VL CDR2 | YASESIS (SEQ ID NO: 416) | YAS (SEQ ID NO: 411) | YASESIS (SEQ ID NO: 416) |
| | VL CDR3 | QQSNSWPTFT (SEQ ID NO: 471) | QQSNWPTFT (SEQ ID NO: 471) | QQSNSWPTFT (SEQ ID NO: 471) |

| | | Chothia | Contact | AbM |
|---|---|---|---|---|
| VH CDR Seq. | VH CDR1 | GYTFTTY (SEQ ID NO: 80) | TTYWMH (SEQ ID NO: 123) | GYTFTTYWMH (SEQ ID NO: 120) |
| | VH CDR2 | PNSG (SEQ ID NO: 207) | WIGMIHPNSGSSN (SEQ ID NO: 208) | MIHPNSGSSN (SEQ ID NO: 209) |
| | VH CDR3 | DYGFIPYFD (SEQ ID NO: 287) | ARSDYGFIPYFD (SEQ ID NO: 288) | SDYGFIPYFDY (SEQ ID NO: 285) |
| VL CDR Seq. | VL CDR1 | SQSIGTS (SEQ ID NO: 363) | GTSIHWY (SEQ ID NO: 364) | RASQSIGTSIH (SEQ ID NO: 361) |
| | VL CDR2 | YAS (SEQ ID NO: 411) | LLIKYASESI (SEQ ID NO: 417) | YASESIS (SEQ ID NO: 416) |
| | VL CDR3 | SNSWPTF (SEQ ID NO: 472) | QQSNSWPTF (SEQ ID NO: 473) | QQSNSWPTFT (SEQ ID NO: 471) |

VH Sequence: QVQLQQSGAELLKPGASVKLSCKASGYTFTTYWMHWVKQRPGQGLEWIGMIHPNSGSS-NYNEKFKNKATLTVDKSSSTAYMQLSSLTSEDSAVY FCARSDYGFIPYFDYWGQGTTLTVSS SEQ ID NO: 35)

VL Sequence: DILLTQSPAILSVSPGERVSFSCRASQSIGTSIHWYQQRTNGSPRLLIKYASESIS-GIPSRFSGSGSGTDFTLIINSVESEDIADYYCQQSNSWPTFTFGAGTKLELK (SEQ ID NO: 36)

TABLE 19

Antibody 6G9 CDR Sequences

| | | Exemplary | IMGT | Kabat |
|---|---|---|---|---|
| VH CDR Seq. | VH CDR1 | GYTFTSYWMQ (SEQ ID NO: 124) | GYTFTSYW (SEQ ID NO: 73) | SYWMQ (SEQ ID NO: 125) |
| | VH CDR2 | EIDPSDSYTNYNQKFKG (SEQ ID NO: 210) | IDPSDSYT (SEQ ID NO: 211) | EIDPSDSYTNYNQKFKG (SEQ ID NO: 210) |
| | VH CDR3 | PLDRSAYYFDY (SEQ ID NO: 289) | ARPLDRSAYYFDY (SEQ ID NO: 290) | PLDRSAYYFDY (SEQ ID NO: 289) |
| VL CDR Seq. | VL CDR1 | RASESVDFSGNSFMH (SEQ ID NO: 365) | ESVDFSGNSF (SEQ ID NO: 366) | RASESVDFSGNSFMH (SEQ ID NO: 365) |
| | VL CDR2 | RASNLDS (SEQ ID NO: 418) | RAS (SEQ ID NO: 419) | RASNLDS (SEQ ID NO: 418) |
| | VL CDR3 | QQSNEDPYT (SEQ ID NO: 474) | QQSNEDPYT (SEQ ID NO: 474) | QQSNEDPYT (SEQ ID NO: 474) |

| | | Chothia | Contact | AbM |
|---|---|---|---|---|
| VH CDR Seq. | VH CDR1 | GYTFTSY (SEQ ID NO: 75) | TSYWMQ (SEQ ID NO: 126) | GYTFTSYWMQ (SEQ ID NO: 124) |
| | VH CDR2 | PSDS (SEQ ID NO: 212) | WIGEIDPSDSYTN (SEQ ID NO: 213) | EIDPSDSYTN (SEQ ID NO: 214) |
| | VH CDR3 | LDRSAYYFD (SEQ ID NO: 291) | ARPLDRSAYYFD (SEQ ID NO: 292) | PLDRSAYYFDY (SEQ ID NO: 289) |
| VL CDR Seq. | VL CDR1 | SESVDFSGNSF (SEQ ID NO: 367) | DFSGNSFMHWY (SEQ ID NO: 368) | RASESVDFSGNSFMH (SEQ ID NO: 365) |
| | VL CDR2 | RAS (SEQ ID NO: 419) | LLIYRASNLD (SEQ ID NO: 420) | RASNLDS (SEQ ID NO: 418) |
| | VL CDR3 | SNEDPY (SEQ ID NO: 475) | QQSNEDPY (SEQ ID NO: 476) | QQSNEDPYT (SEQ ID NO: 474) |

VH Sequence: QVQLHQPGAELVKPGASVKLSCKTSGYTFTSYWMQWVKQRPGQGLEWIGEIDPSDSYT-NYNQKFKGKATLTVDTSSSTAYMQLSSLTSEDSAVYYCARPLDRSAYYFDYWGQGTTLTVSS (SEQ ID NO: 37)

VL Sequence: TL DIVLTQSPASLAVSLGQRATISCRASESVDFSGNSFMHWYQQKPGQPPKWYRASNLDS-GIPARFSGVGSRTDFTLTINPVEADDVATYYCQQSNEDPYTFGGGTKLEIE (SEQ ID NO: 38)

TABLE 20

Antibody 2B11 CDR Sequences

|  |  | Exemplary | IMGT | Kabat |
|---|---|---|---|---|
| VH CDR Seq. | VH CDR1 | GYSITSGYYWN (SEQ ID NO: 127) | GYSITSGYY (SEQ ID NO: 128) | SGYYWN (SEQ ID NO: 129) |
|  | VH CDR2 | HIANDGSNYYNPFLKH (SEQ ID NO: 215) | IANDGSN (SEQ ID NO: 216) | HIANDGSNYYNPFLKH (SEQ ID NO: 215) |
|  | VH CDR3 | GGSYFDYVDY (SEQ ID NO: 293) | ARGGSYFDYVDY (SEQ ID NO: 294) | GGSYFDYVDY (SEQ ID NO: 293) |
| VL CDR Seq. | VL CDR1 | RASQDISNYLN (SEQ ID NO: 369) | QDISNY (SEQ ID NO: 370) | RASQDISNYLN (SEQ ID NO: 369) |
|  | VL CDR2 | YTSRLHS (SEQ ID NO: 421) | YTS (SEQ ID NO: 405) | YTSRLHS (SEQ ID NO: 421) |
|  | VL CDR3 | QQGNTLPFT (SEQ ID NO: 477) | QQGNTLPFT (SEQ ID NO: 477) | QQGNTLPFT (SEQ ID NO: 477) |

|  |  | Chothia | Contact | AbM |
|---|---|---|---|---|
| VH CDR Seq. | VH CDR1 | GYSITSGY (SEQ ID NO: 130) | TSGYYWN (SEQ ID NO: 131) | GYSITSGYYWN (SEQ ID NO: 127) |
|  | VH CDR2 | NDG (SEQ ID NO: 217) | WMGHIANDGSNY (SEQ ID NO: 218) | HIANDGSNY (SEQ ID NO: 219) |
|  | VH CDR3 | GSYFDYVD (SEQ ID NO: 295) | ARGGSYFDYVD (SEQ ID NO: 296) | GGSYFDYVDY (SEQ ID NO: 293) |
| VL CDR Seq. | VL CDR1 | SQDISNY (SEQ ID NO: 371) | SNYLNWY (SEQ ID NO: 372) | RASQDISNYLN (SEQ ID NO: 369) |
|  | VL CDR2 | YTS (SEQ ID NO: 405) | LLIYYTSRLH (SEQ ID NO: 422) | YTSRLHS (SEQ ID NO: 421) |
|  | VL CDR3 | GNTLPF (SEQ ID NO: 478) | QQGNTLPF (SEQ ID NO: 479) | QQGNTLPFT (SEQ ID NO: 477) |

VH Sequence: DVQLQESGPGLVKPSQSLSLTCSVTGYSITSGYYWNWIRQFPGNKLEWMGHIANDGSNYYNPFLKHRVSITRDTSKNQFFLKLNSVTIQDTATYYCARGGSYFDYVDYWGQGTTLTVSS (SEQ ID NO: 39)
VL Sequence: DIQMTQTTSSLSASLGDRVTINCRASQDISNYLNWYQQKPDGTVKLLIYYTSRLHSGVPSRFSGSGSGTDYSLTITNLEQEDIATYFCQQGNTLPFTFGSGTKLEIK (SEQ ID NO: 40)

TABLE 21

Antibody 1A3 CDR Sequences

|  |  | Exemplary | IMGT | Kabat |
|---|---|---|---|---|
| VH CDR Seq. | VH CDR1 | GFTFTDYYMN (SEQ ID NO: 488) | GFTFTDYY (SEQ ID NO: 1795) | DYYMN (SEQ ID NO: 490) |
|  | VH CDR2 | DIIPNNGVTSYNQKFKG (SEQ ID NO: 497) | IIPNNGVT (SEQ ID NO: 498) | DIIPNNGVTSYNQKFKG (SEQ ID NO: 497) |
|  | VH CDR3 | EWLLRGMDY (SEQ ID NO: 515) | AREWLLRGMDY (SEQ ID NO: 516) | EWLLRGMDY (SEQ ID NO: 515) |
| VL CDR Seq. | VL CDR1 | RSSKSLLHSNGITYLY (SEQ ID NO: 531) | KSLLHSNGITY (SEQ ID NO: 532) | RSSKSLLHSNGITYLY (SEQ ID NO: 531) |
|  | VL CDR2 | QMSNLAS (SEQ ID NO: 547) | QMS (SEQ ID NO: 548) | QMSNLAS (SEQ ID NO: 547) |
|  | VL CDR3 | AQHLELTWT (SEQ ID NO: 558) | AQHLELTWT (SEQ ID NO: 558) | AQHLELTWT (SEQ ID NO: 558) |

|  |  | Chothia | Contact | AbM |
|---|---|---|---|---|
| VH CDR Seq. | VH CDR1 | GFTFTDY (SEQ ID NO: 1796) | TDYYMN (SEQ ID NO: 491) | GFTFTDYYMN (SEQ ID NO: 488) |
|  | VH CDR2 | PNNG (SEQ ID NO: 499) | WIGDIIPNNGVTS (SEQ ID NO: 500) | DIIPNNGVTS (SEQ ID NO: 501) |
|  | VH CDR3 | WLLRGMD (SEQ ID NO: 517) | AREWLLRGMD (SEQ ID NO: 518) | EWLLRGMDY (SEQ ID NO: 515) |
| VL CDR Seq. | VL CDR1 | SKSLLHSNGITY (SEQ ID NO: 533) | LHSNGITYLYWY (SEQ ID NO: 534) | RSSKSLLHSNGIT YLY (SEQ ID NO: 531) |
|  | VL CDR2 | QMS (SEQ ID NO: 548) | LLIYQMSNLA (SEQ ID NO: 549) | QMSNLAS (SEQ ID NO: 547) |

TABLE 21-continued

Antibody 1A3 CDR Sequences

|  |  |  |  |
|---|---|---|---|
| VL CDR3 | HLELTW (SEQ ID NO: 559) | AQHLELTW (SEQ ID NO: 560) | AQHLELTWT (SEQ ID NO: 558) |

VH Sequence: EVQLQQSGPELVKPGASVKISCKASGFTFTDYYMNWVKQSHGKSLEWIGDIIPNNGVT-SYNQKFKGKATLTVDKSSSTAYMELRSLTSEDSAVYYCAREWLLRGMDYWGQGTSVTVSS (SEQ ID NO: 480)

VL Sequence: DIVMTQAAFSNPVTLGTSASISCRSSKSLLHSNGITYLYWYLQKPGQSPQLLIYQMSN-LASGVPDRFSSSGSGTDFTLRISRVEAEDVGVYYCAQHLELTWTFGGGTKLEIK (SEQ ID NO: 481)

TABLE 22

Antibody P1B6 CDR Sequences

|  |  | Exemplary | IMGT | Kabat |
|---|---|---|---|---|
| VH CDR Seq. | VH CDR1 | GYTFTDYYMN (SEQ ID NO: 489) | GYTFTDYY (SEQ ID NO: 57) | DYYMN (SEQ ID NO: 490) |
|  | VH CDR2 | DINPNNGGPIYN QKFKG (SEQ ID NO: 502) | INPNNGGP (SEQ ID NO: 503) | DINPNNGGPIYN QKFKG (SEQ ID NO: 502) |
|  | VH CDR3 | SDSAWFTY (SEQ ID NO: 519) | ARSDSAWFTY (SEQ ID NO: 520) | SDSAWFTY (SEQ ID NO: 519) |
| VL CDR Seq. | VL CDR1 | SASSSVSYMY (SEQ ID NO: 535) | SSVSY (SEQ ID NO: 536) | SASSSVSYMY (SEQ ID NO: 535) |
|  | VL CDR2 | DTSNLAS (SEQ ID NO: 550) | DTS (SEQ ID NO: 551) | DTSNLAS (SEQ ID NO: 550) |
|  | VL CDR3 | QQWNSYPPT (SEQ ID NO: 561) | QQWNSYPPT (SEQ ID NO: 561) | QQWNSYPPT (SEQ ID NO: 561) |

|  |  | Chothia | Contact | AbM |
|---|---|---|---|---|
| VH CDR Seq. | VH CDR1 | GYTFTDY (SEQ ID NO: 49) | TDYYMN (SEQ ID NO: 491) | GYTFTDYYMN (SEQ ID NO: 489) |
|  | VH CDR2 | PNNG (SEQ ID NO: 499) | WIGDINPNNGGPI (SEQ ID NO: 504) | DINPNNGGPI (SEQ ID NO: 505) |
|  | VH CDR3 | DSAWFT (SEQ ID NO: 521) | ARSDSAWFT (SEQ ID NO: 522) | SDSAWFTY (SEQ ID NO: 519) |
| VL CDR Seq. | VL CDR1 | SSSVSY (SEQ ID NO: 537) | SYMYWY (SEQ ID NO: 538) | SASSSVSYMY (SEQ ID NO: 535) |
|  | VL CDR2 | DTS (SEQ ID NO: 551) | LLIYDTSNLA (SEQ ID NO: 552) | DTSNLAS (SEQ ID NO: 550) |
|  | VL CDR3 | WNSYPP (SEQ ID NO: 562) | QQWNSYPP (SEQ ID NO: 563) | QQWNSYPPT (SEQ ID NO: 561) |

VH Sequence: EVQLQQSGPELVKPGASVKMSCKASGYTFTDYYMNWVKQTHGKSLEWIGDINPNNGG-PIYNQKFKGKATLTVDKSSSTAYMELRSLTSEDSAVYYCARSDSAWFTWGQGTLVTVSA (SEQ ID NO: 482)

VL Sequence: QIVLTQSPAIMSASPGEKVTMTCSASSSVSYMYWYQQKPGSSPRLLIYDTSNLAS-GVPVRFSGSGSGTFYSITISRMEAEDAATYYCQQWNSYPPTFGGGTKLEIK (SEQ ID NO: 483)

TABLE 23

Antibody P1H8 CDR Sequences

|  |  | Exemplary | IMGT | Kabat |
|---|---|---|---|---|
| VH CDR Seq. | VH CDR1 | GYTFTDYYMN (SEQ ID NO: 489) | GYTFTDYY (SEQ ID NO: 57) | DYYMN (SEQ ID NO: 490) |
|  | VH CDR2 | DINPNNGGTTYN QKFKG (SEQ ID NO: 506) | INPNNGGT (SEQ ID NO: 507) | DINPNNGGTTYN QKFKG (SEQ ID NO: 506) |
|  | VH CDR3 | QGPWYFDV (SEQ ID NO: 523) | ARQGPWYFDV (SEQ ID NO: 524) | QGPWYFDV (SEQ ID NO: 523) |
| VL CDR Seq. | VL CDR1 | RSSQTIVHSNGY TYLE (SEQ ID NO: 539) | QTIVHSNGYTY (SEQ ID NO: 540) | RSSQTIVHSNGY TYLE (SEQ ID NO: 539) |
|  | VL CDR2 | KVSNRFS (SEQ ID NO: 553) | KVS (SEQ ID NO: 554) | KVSNRFS (SEQ ID NO: 553) |
|  | VL CDR3 | FQGSHVPWT (SEQ ID NO: 564) | FQGSHVPWT (SEQ ID NO: 564) | FQGSHVPWT (SEQ ID NO: 564) |

TABLE 23-continued

Antibody P1H8 CDR Sequences

|  |  | Chothia | Contact | AbM |
|---|---|---|---|---|
| VH CDR Seq. | VH CDR1 | GYTFTDY (SEQ ID NO: 49) | TDYYMN (SEQ ID NO: 491) | GYTFTDYYMN (SEQ ID NO: 489) |
|  | VH CDR2 | PNNG T (SEQ ID NO: 499) | WIGDINPNNGGT (SEQ ID NO: 508) | DINPNNGGTT (SEQ ID NO: 509) |
|  | VH CDR3 | GPWYFD (SEQ ID NO: 525) | ARQGPWYFD (SEQ ID NO: 526) | QGPWYFDV (SEQ ID NO: 523) |
| VL CDR Seq. | VL CDR1 | SQTIVHSNGYTY (SEQ ID NO: 541) | VHSNGYTYLEWY (SEQ ID NO: 542) | RSSQTIVHSNGY TYLE (SEQ ID NO: 539) |
|  | VL CDR2 | KVS (SEQ ID NO: 554) | LLIYKVSNRF (SEQ ID NO: 555) | KVSNRFS (SEQ ID NO: 553) |
|  | VL CDR3 | QGSHVPW (SEQ ID NO: 565) | FQGSHVPW (SEQ ID NO: 566) | FQGSHVPWT (SEQ ID NO: 564) |

VH Sequence: EVQLQQSGPELVKPGASVKISCKASGYTFTDYYMNWVKQSHGKSLEWIGDINPNNGGT-TYNQFKGKATLTVDKSSSTAYMELRSLTSEDSAVYYCARQGPWYFDVWGTGTTVTVSS (SEQ ID NO: 484)

VL Sequence: DVLMTQTPLSLPVSLGDQASISCRSSQTIVHSNGYTYLEWYLQKPGQSPKWYKVSNRF-SGVPDRFSGSGSGTDFTLKISRVEAEDLGVYYCFQGSHVPWTFGGGTKLEIK (SEQ ID NO: 485)

TABLE 24

Antibody P8G4 CDR Sequences

|  |  | Exemplary | IMGT | Kabat |
|---|---|---|---|---|
| VH CDR Seq. | VH CDR1 | GFSLTSYGVH (SEQ ID NO: 492) | GFSLTSYG (SEQ ID NO: 493) | SYGVH (SEQ ID NO: 494) |
|  | VH CDR2 | VLWSGGSTDYN AAFIS (SEQ ID NO: 510) | LWSGGST (SEQ ID NO: 511) | VLWSGGSTDYN AAFIS (SEQ ID NO: 510) |
|  | VH CDR3 | NFGDY (SEQ ID NO: 527) | ARNFGDY (SEQ ID NO: 528) | NFGDY (SEQ ID NO: 527) |
| VL CDR Seq. | VL CDR1 | SASSRVSYMH (SEQ ID NO: 543) | SRVSY (SEQ ID NO: 544) | SASSRVSYMH (SEQ ID NO: 543) |
|  | VL CDR2 | DTSKLAS (SEQ ID NO: 556) | DTS (SEQ ID NO: 551) | DTSKLAS (SEQ ID NO: 556) |
|  | VL CDR3 | QQWNNNPPT (SEQ ID NO: 567) | QQWNNNPPT (SEQ ID NO: 567) | QQWNNNPPT (SEQ ID NO: 567) |

|  |  | Chothia | Contact | AbM |
|---|---|---|---|---|
| VH CDR Seq. | VH CDR1 | GFSLTSY (SEQ ID NO: 495) | TSYGVH (SEQ ID NO: 496) | GFSLTSYGVH (SEQ ID NO: 492) |
|  | VH CDR2 | GGS (SEQ ID NO: 512) | WLGVLWSGGST D (SEQ ID NO: 513) | VLWSGGSTD (SEQ ID NO: 514) |
|  | VH CDR3 | FGD (SEQ ID NO: 529) | ARNFGD (SEQ ID NO: 530) | NFGDY (SEQ ID NO: 527) |
| VL CDR Seq. | VL CDR1 | SSRVSY (SEQ ID NO: 545) | SYMHWY (SEQ ID NO: 546) | SASSRVSYMH (SEQ ID NO: 543) |
|  | VL CDR2 | DTS (SEQ ID NO: 551) | RWIYDTSKLA (SEQ ID NO: 557) | DTSKLAS (SEQ ID NO: 556) |
|  | VL CDR3 | WNNNPP (SEQ ID NO: 568) | QQWNNNPP (SEQ ID NO: 569) | QQWNNNPPT (SEQ ID NO: 567) |

VH Sequence: (SEQ ID NO: 486)
QVQLKQSGPGLVQPSQSLSITCTVSGFSLTSYGVHWVRQSPGKGLDWLGVLWSGGSTDY

NAAFISRLSISKDNSKSQVFFKMNSLQADDTAIYYCARNFGDYWGQGTSVTVSS

VL Sequence: (SEQ ID NO: 487)
QIVLTQSPAIMSASPGEKVTMTCSASSRVSYMHWYQQKSGTSPKRWIYDTSKLASGVPA

RFSGSGSGTSYSLTISSMEAEDAATYYCQQWNNNPPTFGAGTTLELK

In some embodiments, the antibodies provided herein comprise a VH region or VH domain In other embodiments, the antibodies provided herein comprise a VL region or VL chain. In some embodiments, the antibodies provided herein have a combination of (i) a VH domain or VH region; and/or (ii) a VL domain or VL region.

In some embodiments, an antibody provided herein comprises or consists of six CDRs, for example, VH CDR1, VH CDR2, VH CDR3, VL CDR1, VL CDR2, and/or VL CDR3 identified in Tables 1-24. In some embodiments, an antibody provided herein can comprise less than six CDRs. In some embodiments, the antibody comprises or consists of one, two, three, four, or five CDRs selected from the group consisting of VH CDR1, VH CDR2, VH CDR3, VL CDR1, VL CDR2, and/or VL CDR3 identified in Tables 1-24. In some embodiments, the antibody comprises or consists of one, two, three, four, or five CDRs selected from the group consisting of VH CDR1, VH CDR2, VH CDR3, VL CDR1, VL CDR2, and/or VL CDR3 of the murine monoclonal antibody selected from the group consisting of: (a) the antibody designated 1C1; (b) the antibody designated 3P10; (c) the antibody designated 12A3; (d) the antibody designated 5F12; (e) the antibody designated 5A20; (f) the antibody designated 8D8; (g) the antibody designated 17J16; (h) t the antibody designated 25M22; (i) the antibody designated 2B8; (j) the antibody designated 22N5; (k) the antibody designated 2I23; (l) the antibody designated 6N16; (m) the antibody designated 1B3; (n) the antibody designated 19K19; (o) the antibody designated 2B3; (p) the antibody designated 8C10; (q) the antibody designated 2A9; (r) the antibody designated 24G2; (s) the antibody designated 6G9; (t) the antibody designated 2B11; (u) the antibody designated 1A3; (v) the antibody designated P1B6; (w) the antibody designated P1H8; or (x) the antibody designated P8G4 described herein. Accordingly, in some embodiments, the antibody comprises or consists of one, two, three four or five CDRs of anyone of the VH CDR1, VH CDR2, VH CDR3, VL CDR1, VL CDR2, and/or VL CDR3 identified in Tables 1-24.

In some embodiments, the antibodies provided herein comprise or consist of one or more (e.g., one, two or three) VH CDRs listed in Tables 1-24. In other embodiments, the antibodies provided herein comprise one or more (e.g., one, two or three) VL CDRs listed in Tables 1-24. In yet other embodiments, the antibodies provided herein comprise one or more (e.g., one, two or three) VH CDRs listed in Tables 1-24 and one or more VL CDRs listed in Tables 1-24. Accordingly, in certain embodiments, the antibodies comprise a VH CDR1 having the amino acid sequence of any one of SEQ ID NOS: 57, 49, 57, 49, 221-296, 515-530, 488-493, 1795, 1796, 488-493, 1795, 1796. In another embodiment, the antibodies comprise a VH CDR2 having the amino acid sequence of any one of SEQ ID NOS: 132-220, 497-514. In another embodiment, the antibodies comprise a VH CDR3 having the amino acid sequence of any one of SEQ ID NOS: 57, 49, 57, 49, 221-296, 515-530, 488-493, 1795, 1796, 488-493, 1795, 1796. In certain embodiments, the antibodies comprise a VH CDR1 and/or a VH CDR2 and/or a VH CDR3 independently selected from a VH CDR1, VH CDR2, VH CDR3 as depicted in any one of the amino acid sequences depicted in Table 1-24. In certain embodiments, the antibodies comprise a VL CDR1 having the amino acid sequence of any one of SEQ ID NOS: 297-372, 531-546. In another embodiment, the antibodies comprise a VL CDR2 having the amino acid sequence of any one of SEQ ID NOS: 373-422. In another embodiment, the antibodies comprise a VL CDR3 having the amino acid sequence of any one of SEQ ID NOS: 423-479, 558-569. In certain embodiments, the antibodies comprise a VL CDR1 and/or a VL CDR2 and/or a VL CDR3 independently selected from a VL CDR1, VL CDR2, VL CDR3 as depicted in any one of the amino acid sequences depicted in Tables 1-24.

Also provided herein are antibodies comprising one or more (e.g., one, two or three) VH CDRs and one or more (e.g., one, two or three) VL CDRs listed in Tables 1-24. In particular, provided herein is an antibody comprising: a VH CDR1 (SEQ ID NOS: 57, 49, 221-296, 515-530, 488-493, 1795, 1796) and a VL CDR1 (SEQ ID NOS: 297-372, 531-546); a VH CDR1 (SEQ ID NOS: 57, 49, 221-296, 515-530, 488-493, 1795, 1796) and a VL CDR2 (SEQ ID NOS: 373-422); a VH CDR1 (SEQ ID NOS: 57, 49, 221-296, 515-530, 488-493, 1795, 1796) and a VL CDR3 (SEQ ID NOS: 423-479, 558-569); a VH CDR2 (SEQ ID NOS: 132-220, 497-514) and a VL CDR1 (SEQ ID NOS: 297-372, 531-546); a VH CDR2 (SEQ ID NOS: 132-220, 497-514) and a VL CDR2 (SEQ ID NOS: 373-422); a VH CDR2 (SEQ ID NOS: 132-220, 497-514) and a VL CDR3 (SEQ ID NOS: 423-479, 558-569); a VH CDR3 (SEQ ID NOS: 57, 49, 221-296, 515-530, 488-493, 1795, 1796) and a VL CDR1 (SEQ ID NOS: 297-372, 531-546); a VH CDR3 (SEQ ID NOS: 57, 49, 221-296, 515-530, 488-493, 1795, 1796) and a VL CDR2 (SEQ ID NOS: 373-422); a VH CDR3 (SEQ ID NOS: 57, 49, 221-296, 515-530, 488-493, 1795, 1796) and a VL CDR3 (SEQ ID NOS: 423-479, 558-569); a VH CDR1 (SEQ ID NOS: 57, 49, 221-296, 515-530, 488-493, 1795, 1796), a VH CDR2 (SEQ ID NOS: 132-220, 497-514) and a VL CDR1 (SEQ ID NOS: 297-372, 531-546); a VH CDR1 (SEQ ID NOS: 57, 49, 221-296, 515-530, 488-493, 1795, 1796), a VH CDR2 (SEQ ID NOS: 132-220, 497-514) and a VL CDR2 (SEQ ID NOS: 373-422); a VH CDR1 (SEQ ID NOS: 57, 49, 221-296, 515-530, 488-493, 1795, 1796), a VH CDR2 (SEQ ID NOS: 132-220, 497-514) and a VL CDR3 (SEQ ID NOS: 423-479, 558-569); a VH CDR2 (SEQ ID NOS: 132-220, 497-514), a VH CDR3 (SEQ ID NOS: 57, 49, 221-296, 515-530, 488-493, 1795, 1796) and a VL CDR1 (SEQ ID NOS: 297-372, 531-546), a VH CDR2 (SEQ ID NOS: 132-220, 497-514), a VH CDR3 (SEQ ID NOS: 57, 49, 221-296, 515-530, 488-493, 1795, 1796) and a VL CDR2 (SEQ ID NOS: 373-422); a VH CDR2 (SEQ ID NOS: 132-220, 497-514), a VH CDR3 (SEQ ID NOS: 57, 49, 221-296, 515-530, 488-493, 1795, 1796) and a VL CDR3 (SEQ ID NOS: 423-479, 558-569); a VH CDR1 (SEQ ID NOS: 57, 49, 221-296, 515-530, 488-493, 1795, 1796), a VL CDR1 (SEQ ID NOS: 297-372, 531-546) and a VL CDR2 (SEQ ID NOS: 373-422); a VH CDR1 (SEQ ID NOS: 57, 49, 221-296, 515-530, 488-493, 1795, 1796), a VL CDR1 (SEQ ID NOS: 297-372, 531-546) and a VL CDR3 (SEQ ID NOS: 423-479, 558-569); a VH CDR1 (SEQ ID NOS: 57, 49, 221-296, 515-530, 488-493, 1795, 1796), a VL CDR2 (SEQ ID NOS: 373-422) and a VL CDR3 (SEQ ID NOS: 423-479, 558-569); a VH CDR2 (SEQ ID NOS: 132-220, 497-514), a VL CDR1 (SEQ ID NOS: 297-372, 531-546) and a VL CDR2 (SEQ ID NOS: 373-422); a VH CDR2 (SEQ ID NOS: 132-220, 497-514), a VL CDR1 (SEQ ID NOS: 297-372, 531-546) and a VL CDR3 (SEQ ID NOS: 423-479, 558-569); a VH CDR2 (SEQ ID NOS: 132-220, 497-514), a VL CDR2 (SEQ ID NOS: 373-422) and a VL CDR3 (SEQ ID NOS: 423-479, 558-569); a VH CDR3 (SEQ ID NOS: 57, 49, 221-296, 515-530, 488-493, 1795, 1796), a VL CDR1 (SEQ ID NOS: 297-372, 531-546) and a VL CDR2 (SEQ ID NOS: 373-422); a VH CDR3 (SEQ ID NOS: 57, 49, 221-296, 515-530, 488-493, 1795, 1796), a VL CDR1 (SEQ ID NOS: 297-372, 531-546) and a VL CDR3 (SEQ ID NOS: 423-479, 558-569); a VH CDR3 (SEQ ID NOS: 57, 49, 221-296, 515-530, 488-493, 1795, 1796), a VL CDR2 (SEQ ID NOS: 373-422) and a VL CDR3 (SEQ ID NOS: 423-479, 558-569); a VH CDR1 (SEQ ID NOS: 57, 49, 221-296, 515-530, 488-493, 1795, 1796), a VH CDR2 (SEQ ID NOS: 132-220, 497-514), a VH CDR3 (SEQ ID NOS: 57, 49, 221-296, 515-530, 488-493, 1795, 1796) and a VL CDR1 (SEQ ID NOS: 297-372, 531-546); a VH CDR1 (SEQ ID NOS: 57, 49, 221-296, 515-530, 488-493, 1795, 1796), a VH CDR2 (SEQ ID NOS: 132-220, 497-514), a VH CDR3 (SEQ ID NOS: 57, 49, 221-296, 515-530, 488-493, 1795, 1796) and a VL CDR2 (SEQ ID NOS: 373-422); a VH CDR1 (SEQ ID NOS: 57, 49, 221-296, 515-530, 488-493, 1795, 1796), a VH CDR2 (SEQ ID NOS: 132-220, 497-514), a VH CDR3 (SEQ ID NOS: 57, 49, 221-296, 515-530, 488-493, 1795, 1796) and a VL CDR3 (SEQ ID NOS: 423-479, 558-569); a VH CDR1 (SEQ ID NOS: 57, 49, 221-296, 515-530, 488-493, 1795, 1796), a VH CDR2 (SEQ ID NOS: 132-220, 497-514), a VL CDR1 (SEQ ID NOS: 297-372, 531-546) and a VL CDR2 (SEQ ID NOS: 373-422); a VH CDR1 (SEQ ID NOS: 57, 49, 221-296, 515-530, 488-493, 1795, 1796), a VH CDR2 (SEQ ID NOS: 132-220, 497-514), a VL CDR1 (SEQ ID NOS: 297-372, 531-546) and a VL CDR3 (SEQ ID NOS: 423-479, 558-569); a VH CDR1 (SEQ ID NOS: 57, 49, 221-296, 515-530, 488-493, 1795, 1796), a VH CDR2 (SEQ ID NOS: 132-220, 497-514), a VL CDR2 (SEQ ID NOS: 373-422) and a VL CDR3 (SEQ ID NOS: 423-479, 558-569); a VH CDR1 (SEQ ID NOS: 57, 49, 221-296, 515-530, 488-493, 1795, 1796), a VH CDR3 (SEQ ID NOS: 57, 49, 221-296, 515-530, 488-493, 1795, 1796), a VL CDR1 (SEQ ID NOS: 297-372, 531-546) and a VL CDR2 (SEQ ID NOS: 373-422); a VH CDR1 (SEQ ID NOS: 57, 49, 221-296, 515-530, 488-493, 1795, 1796), a VH CDR3 (SEQ ID NOS: 57, 49, 221-296, 515-530, 488-493, 1795, 1796), a VL CDR1 (SEQ ID NOS: 297-372, 531-546) and a VL CDR3 (SEQ ID NOS: 423-479, 558-569); a VH CDR1 (SEQ ID NOS: 57, 49, 221-296, 515-530, 488-493, 1795, 1796), a VH CDR3 (SEQ ID NOS: 57, 49, 221-296, 515-530, 488-493, 1795, 1796), a VL CDR2 (SEQ ID NOS: 373-422) and a VL CDR3 (SEQ ID NOS: 423-479, 558-569); a VH CDR2 (SEQ ID NOS: 132-220, 497-514), a VH CDR3 (SEQ ID NOS: 57, 49, 221-296, 515-530, 488-493, 1795, 1796), a VL CDR1 (SEQ ID NOS: 297-372, 531-546) and a VL CDR2 (SEQ ID NOS: 373-422); a VH CDR2 (SEQ ID NOS: 132-220, 497-514), a VH CDR3 (SEQ ID NOS: 57, 49, 221-296, 515-530, 488-493, 1795, 1796), a VL CDR1 (SEQ ID NOS: 297-372, 531-546) and a VL CDR3 (SEQ ID NOS: 423-479, 558-569); a VH CDR2 (SEQ ID NOS: 132-220, 497-514), a VH CDR3 (SEQ ID NOS: 57, 49, 221-296, 515-530, 488-493, 1795, 1796), a VL CDR2 (SEQ ID NOS: 373-422) and a VL CDR3 (SEQ ID NOS: 423-479, 558-569); a VH CDR1 (SEQ ID NOS: 57, 49, 221-296, 515-530, 488-493, 1795, 1796), a VH CDR2 (SEQ ID NOS: 132-220, 497-514), a VH CDR3 (SEQ ID NOS: 57, 49, 221-296, 515-530, 488-493, 1795, 1796), a VL CDR1 (SEQ ID NOS: 297-372, 531-546) and a VL CDR2 (SEQ ID NOS: 373-422); a VH CDR1 (SEQ ID NOS: 57, 49, 221-296, 515-530, 488-493, 1795, 1796), a VH CDR2 (SEQ ID NOS: 132-220, 497-514), a VH CDR3 (SEQ ID NOS: 57, 49, 221-296, 515-530, 488-493, 1795, 1796), a VL CDR1 (SEQ ID NOS: 297-372, 531-546) and a VL CDR3 (SEQ ID NOS: 423-479, 558-569); a VH CDR1 (SEQ ID NOS: 57, 49, 221-296, 515-530, 488-493, 1795, 1796), a VH CDR2 (SEQ ID NOS: 132-220, 497-514), a VH CDR3 (SEQ ID NOS: 57, 49, 221-296, 515-530, 488-493, 1795, 1796), a VL CDR2 (SEQ ID NOS: 373-422) and a VL CDR3 (SEQ ID NOS: 423-479, 558-569); a VH CDR1 (SEQ ID NOS: 57, 49, 221-296, 515-530, 488-493, 1795, 1796), a VH CDR2 (SEQ ID NOS: 132-220, 497-514), a VL CDR1 (SEQ ID NOS: 297-372, 531-546), a VL CDR2 (SEQ ID NOS: 373-422), and a VL CDR3 (SEQ ID NOS: 423-479, 558-569); a VH CDR1 (SEQ ID NOS: 57, 49, 221-296, 515-530, 488-493, 1795, 1796), a VH CDR3 (SEQ ID NOS: 57, 49, 221-296, 515-530, 488-493, 1795, 1796), a VL CDR1 (SEQ ID NOS: 297-372, 531-546), a VL CDR2 (SEQ ID NOS: 373-422), and a VL CDR3 (SEQ ID NOS: 423-479, 558-569); a VH CDR2 (SEQ ID NOS: 132-220, 497-514), a VH CDR3 (SEQ ID NOS: 57, 49, 221-296, 515-530, 488-493, 1795, 1796), a VL CDR1 (SEQ ID NOS: 297-372, 531-546), a VL CDR2 (SEQ ID NOS: 373-422), and a VL CDR3 (SEQ ID NOS: 423-479, 558-569); or any combination thereof of the VH CDRs (SEQ ID NOS: 41-296) and VL CDRs (SEQ ID NOS: 297-477) listed in Tables 1-24.

In certain embodiments, an antibody or fragment thereof described herein comprises a humanized framework region (FR) sequence. In certain embodiments, an antibody or fragment thereof described herein comprises a VH region comprising a VH FR1, a VH FR2, a VH FR3 and a VH FR4 amino acid sequence depicted in Table 25; and/or (b) a VL region comprising a VL FR1, a VL FR2, a VL FR3 and a VL FR4 amino acid sequence depicted in Table 25.

TABLE 25

Exemplary Framework Sequences for Humanized Anti-GFRAL Antibodies

| VH | Clones Humanized | SEQ ID NO: |
|---|---|---|
| VH Framework 1 (FR1) | | |
| QVQLQESGPGLVKPSETLSLTCTVS | 1C1 | 570 |
| QMQLQESGPGLVKPSETLSLTCTVS | 1C1 | 571 |
| QVQLVQSGAEVKKPGSSVKVSCKAS | 3P10, 5F12, 25M22, 17J16 | 572 |
| QIQLVQSGAEVKKPGSSVKVSCKAS | 3P10 | 573 |
| QVQLVQSGAEVKKPGATVKISCKVS | 3P10 | 574 |
| QIQLVQSGAEVKKPGATVKISCKVS | 3P10 | 575 |
| QVQLVQSGAEVVKPGSSVKVSCKAS | 5F12 | 576 |

TABLE 25-continued

Exemplary Framework Sequences for Humanized Anti-GFRAL Antibodies

| Sequence | Antibody | SEQ ID NO |
|---|---|---|
| QVQLVQSGAEVKKPGASVKVSCKAS | 5F12 | 577 |
| EVQLVQSGAEVKKPGESLKISCKGS | 25M22 | 578 |
| VH Framework 2 (FR2) | | |
| WIRQPPGKGLEWIG | 1C1 | 579 |
| WIRQPPGKGLEWLG | 1C1 | 580 |
| WVRQAPGQGLEWMG | 3P10, 5F12, 25M22, 17J16 | 581 |
| WVRQAPGKGLEWMG | 3P10 | 582 |
| WVRQAPGQALEWMG | 3P10 | 583 |
| WVRQAPGQGLKWMG | 3P10 | 584 |
| WVRQAPGKALEWMG | 3P10 | 585 |
| WVRQAPGKGLKWMG | 3P10 | 586 |
| WVRQAPGQALKWMG | 3P10 | 587 |
| WVRQAPGKALKWMG | 3P10 | 588 |
| WVKQAPGQGLEWIG | 5F12, 17J16 | 589 |
| WVRQAPGQGLEWIG | 5F12, 25M22, 17J16 | 590 |
| WVRQAPGQGLEWIA | 5F12 | 591 |
| WVKQAPGQGLEWIG | 5F12, 17J16 | 592 |
| WVKQAPGQGLEWIA | 5F12 | 593 |
| WVRQAPGQGLEWIA | 5F12 | 594 |
| WVKQAPGQGLEWIA | 5F12 | 595 |
| WMQQAPGKGLEWIG | 3P10 | 596 |
| WVRQAPGQRLEWMG | 5F12 | 597 |
| WVRQAPGQRLEWIG | 5F12 | 598 |
| WVRQAPGQRLEWMA | 5F12 | 599 |
| WVRQAPGQRLEWIA | 5F12 | 600 |
| WVRQMPGKGLEWMG | 25M22 | 601 |
| WVRQMPGKGLEWIG | 25M22 | 602 |
| VH Framework 3 (FR3) | | |
| RVTISVDTSKNQFSLKLSSVTAADTAVYYCAR | 1C1 | 603 |
| RLTISVDTSKNQFSLKLSSVTAADTAVYYCAR | 1C1 | 604 |
| RVTISKDTSKNQFSLKLSSVTAADTAVYYCAR | 1C1 | 605 |
| RVTISVDNSKNQFSLKLSSVTAADTAVYYCAR | 1C1 | 606 |
| RVTISVDTSKSQFSLKLSSVTAADTAVYYCAR | 1C1 | 607 |
| RVTISVDTSKNQVSLKLSSVTAADTAVYYCAR | 1C1 | 608 |
| RVTISVDTSKNQFSFKLSSVTAADTAVYYCAR | 1C1 | 609 |
| RVTISVDTSKNQFSLKMSSVTAADTAVYYCAR | 1C1 | 610 |
| RVTISVDTSKNQFSLKLSSLTAADTAVYYCAR | 1C1 | 611 |
| RVTISVDTSKNQFSLKLSSVQAADTAVYYCAR | 1C1 | 612 |

TABLE 25-continued

Exemplary Framework Sequences for Humanized Anti-GFRAL Antibodies

| Sequence | Clone | SEQ ID NO |
|---|---|---|
| RVTISVDTSKNQFSLKLSSVTAQDTAVYYCAR | 1C1 | 613 |
| RLTISKDTSKNQFSLKLSSVTAADTAVYYCAR | 1C1 | 614 |
| RLTISVDNSKNQFSLKLSSVTAADTAVYYCAR | 1C1 | 615 |
| RLTISVDTSKSQFSLKLSSVTAADTAVYYCAR | 1C1 | 616 |
| RLTISVDTSKNQVSLKLSSVTAADTAVYYCAR | 1C1 | 617 |
| RLTISVDTSKNQFSFKLSSVTAADTAVYYCAR | 1C1 | 618 |
| RLTISVDTSKNQFSLKMSSVTAADTAVYYCAR | 1C1 | 619 |
| RLTISVDTSKNQFSLKLSSLTAADTAVYYCAR | 1C1 | 620 |
| RLTISVDTSKNQFSLKLSSVQAADTAVYYCAR | 1C1 | 621 |
| RLTISVDTSKNQFSLKLSSVTAQDTAVYYCAR | 1C1 | 622 |
| RVTISKDNSKNQFSLKLSSVTAADTAVYYCAR | 1C1 | 623 |
| RVTISKDTSKSQFSLKLSSVTAADTAVYYCAR | 1C1 | 624 |
| RVTISKDTSKNQVSLKLSSVTAADTAVYYCAR | 1C1 | 625 |
| RVTISKDTSKNQFSFKLSSVTAADTAVYYCAR | 1C1 | 626 |
| RVTISKDTSKNQFSLKMSSVTAADTAVYYCAR | 1C1 | 627 |
| RVTISKDTSKNQFSLKLSSLTAADTAVYYCAR | 1C1 | 628 |
| RVTISKDTSKNQFSLKLSSVQAADTAVYYCAR | 1C1 | 629 |
| RVTISKDTSKNQFSLKLSSVTAQDTAVYYCAR | 1C1 | 630 |
| RVTISVDNSKSQFSLKLSSVTAADTAVYYCAR | 1C1 | 631 |
| RVTISVDNSKNQVSLKLSSVTAADTAVYYCAR | 1C1 | 632 |
| RVTISVDNSKNQFSFKLSSVTAADTAVYYCAR | 1C1 | 633 |
| RVTISVDNSKNQFSLKMSSVTAADTAVYYCAR | 1C1 | 634 |
| RVTISVDNSKNQFSLKLSSLTAADTAVYYCAR | 1C1 | 635 |
| RVTISVDNSKNQFSLKLSSVQAADTAVYYCAR | 1C1 | 636 |
| RVTISVDNSKNQFSLKLSSVTAQDTAVYYCAR | 1C1 | 637 |
| RVTISVDTSKSQVSLKLSSVTAADTAVYYCAR | 1C1 | 638 |
| RVTISVDTSKSQFSFKLSSVTAADTAVYYCAR | 1C1 | 639 |
| RVTISVDTSKSQFSLKMSSVTAADTAVYYCAR | 1C1 | 640 |
| RVTISVDTSKSQFSLKLSSLTAADTAVYYCAR | 1C1 | 641 |
| RVTISVDTSKSQFSLKLSSVQAADTAVYYCAR | 1C1 | 642 |
| RVTISVDTSKSQFSLKLSSVTAQDTAVYYCAR | 1C1 | 643 |
| RVTISVDTSKNQVSFKLSSVTAADTAVYYCAR | 1C1 | 644 |
| RVTISVDTSKNQVSLKMSSVTAADTAVYYCAR | 1C1 | 645 |
| RVTISVDTSKNQVSLKLSSLTAADTAVYYCAR | 1C1 | 646 |
| RVTISVDTSKNQVSLKLSSVQAADTAVYYCAR | 1C1 | 647 |
| RVTISVDTSKNQVSLKLSSVTAQDTAVYYCAR | 1C1 | 648 |
| RVTISVDTSKNQFSFKMSSVTAADTAVYYCAR | 1C1 | 649 |
| RVTISVDTSKNQFSFKLSSLTAADTAVYYCAR | 1C1 | 650 |
| RVTISVDTSKNQFSFKLSSVQAADTAVYYCAR | 1C1 | 651 |

TABLE 25-continued

Exemplary Framework Sequences for Humanized Anti-GFRAL Antibodies

| Sequence | Clone | SEQ ID NO |
|---|---|---|
| RVTISVDTSKNQFSFKLSSVTAQDTAVYYCAR | 1C1 | 652 |
| RVTISVDTSKNQFSLKMSSLTAADTAVYYCAR | 1C1 | 653 |
| RVTISVDTSKNQFSLKMSSVQAADTAVYYCAR | 1C1 | 654 |
| RVTISVDTSKNQFSLKMSSVTAQDTAVYYCAR | 1C1 | 655 |
| RVTISVDTSKNQFSLKLSSLQAADTAVYYCAR | 1C1 | 656 |
| RVTISVDTSKNQFSLKLSSLTAQDTAVYYCAR | 1C1 | 657 |
| RVTISVDTSKNQFSLKLSSVQAQDTAVYYCAR | 1C1 | 658 |
| RLTISKDNSKNQFSLKLSSVTAADTAVYYCAR | 1C1 | 659 |
| RLTISKDTSKSQFSLKLSSVTAADTAVYYCAR | 1C1 | 660 |
| RLTISKDTSKNQVSLKLSSVTAADTAVYYCAR | 1C1 | 661 |
| RLTISKDTSKNQFSFKLSSVTAADTAVYYCAR | 1C1 | 662 |
| RLTISKDTSKNQFSLKMSSVTAADTAVYYCAR | 1C1 | 663 |
| RLTISKDTSKNQFSLKLSSLTAADTAVYYCAR | 1C1 | 664 |
| RLTISKDTSKNQFSLKLSSVQAADTAVYYCAR | 1C1 | 665 |
| RLTISKDTSKNQFSLKLSSVTAQDTAVYYCAR | 1C1 | 666 |
| RLTISVDNSKSQFSLKLSSVTAADTAVYYCAR | 1C1 | 667 |
| RLTISVDNSKNQVSLKLSSVTAADTAVYYCAR | 1C1 | 668 |
| RLTISVDNSKNQFSFKLSSVTAADTAVYYCAR | 1C1 | 669 |
| RLTISVDNSKNQFSLKMSSVTAADTAVYYCAR | 1C1 | 670 |
| RLTISVDNSKNQFSLKLSSLTAADTAVYYCAR | 1C1 | 671 |
| RLTISVDNSKNQFSLKLSSVQAADTAVYYCAR | 1C1 | 672 |
| RLTISVDNSKNQFSLKLSSVTAQDTAVYYCAR | 1C1 | 673 |
| RLTISVDTSKSQVSLKLSSVTAADTAVYYCAR | 1C1 | 674 |
| RLTISVDTSKSQFSFKLSSVTAADTAVYYCAR | 1C1 | 675 |
| RLTISVDTSKSQFSLKMSSVTAADTAVYYCAR | 1C1 | 676 |
| RLTISVDTSKSQFSLKLSSLTAADTAVYYCAR | 1C1 | 677 |
| RLTISVDTSKSQFSLKLSSVQAADTAVYYCAR | 1C1 | 678 |
| RLTISVDTSKSQFSLKLSSVTAQDTAVYYCAR | 1C1 | 679 |
| RLTISVDTSKNQVSFKLSSVTAADTAVYYCAR | 1C1 | 680 |
| RLTISVDTSKNQVSLKMSSVTAADTAVYYCAR | 1C1 | 681 |
| RLTISVDTSKNQVSLKLSSLTAADTAVYYCAR | 1C1 | 682 |
| RLTISVDTSKNQVSLKLSSVQAADTAVYYCAR | 1C1 | 683 |
| RLTISVDTSKNQVSLKLSSVTAQDTAVYYCAR | 1C1 | 684 |
| RLTISVDTSKNQFSFKMSSVTAADTAVYYCAR | 1C1 | 685 |
| RLTISVDTSKNQFSFKLSSLTAADTAVYYCAR | 1C1 | 686 |
| RLTISVDTSKNQFSFKLSSVQAADTAVYYCAR | 1C1 | 687 |
| RLTISVDTSKNQFSFKLSSVTAQDTAVYYCAR | 1C1 | 688 |
| RLTISVDTSKNQFSLKMSSLTAADTAVYYCAR | 1C1 | 689 |
| RLTISVDTSKNQFSLKMSSVQAADTAVYYCAR | 1C1 | 690 |

TABLE 25-continued

Exemplary Framework Sequences for Humanized Anti-GFRAL Antibodies

| | | |
|---|---|---|
| RLTISVDTSKNQFSLKMSSVTAQDTAVYYCAR | 1C1 | 691 |
| RLTISVDTSKNQFSLKLSSLQAADTAVYYCAR | 1C1 | 692 |
| RLTISVDTSKNQFSLKLSSLTAQDTAVYYCAR | 1C1 | 693 |
| RLTISVDTSKNQFSLKLSSVQAQDTAVYYCAR | 1C1 | 694 |
| RVTISKDNSKQFSLKLSSVTAADTAVYYCAR | 1C1 | 695 |
| RVTISKDNSKNQVSLKLSSVTAADTAVYYCAR | 1C1 | 696 |
| RVTISKDNSKNQFSFKLSSVTAADTAVYYCAR | 1C1 | 697 |
| RVTISKDNSKNQFSLKMSSVTAADTAVYYCAR | 1C1 | 698 |
| RVTISKDNSKNQFSLKLSSLTAADTAVYYCAR | 1C1 | 699 |
| RVTISKDNSKNQFSLKLSSVQAADTAVYYCAR | 1C1 | 700 |
| RVTISKDNSKNQFSLKLSSVTAQDTAVYYCAR | 1C1 | 701 |
| RVTISKDTSKQVSLKLSSVTAADTAVYYCAR | 1C1 | 702 |
| RVTISKDTSKSQFSFKLSSVTAADTAVYYCAR | 1C1 | 703 |
| RVTISKDTSKSQFSLKMSSVTAADTAVYYCAR | 1C1 | 704 |
| RVTISKDTSKSQFSLKLSSLTAADTAVYYCAR | 1C1 | 705 |
| RVTISKDTSKSQFSLKLSSVQAADTAVYYCAR | 1C1 | 706 |
| RVTISKDTSKSQFSLKLSSVTAQDTAVYYCAR | 1C1 | 707 |
| RVTISKDTSKNQVSFKLSSVTAADTAVYYCAR | 1C1 | 708 |
| RVTISKDTSKNQVSLKMSSVTAADTAVYYCAR | 1C1 | 709 |
| RVTISKDTSKNQVSLKLSSLTAADTAVYYCAR | 1C1 | 710 |
| RVTISKDTSKNQVSLKLSSVQAADTAVYYCAR | 1C1 | 711 |
| RVTISKDTSKNQVSLKLSSVTAQDTAVYYCAR | 1C1 | 712 |
| RVTISKDTSKNQFSFKMSSVTAADTAVYYCAR | 1C1 | 713 |
| RVTISKDTSKNQFSFKLSSLTAADTAVYYCAR | 1C1 | 714 |
| RVTISKDTSKNQFSFKLSSVQAADTAVYYCAR | 1C1 | 715 |
| RVTISKDTSKNQFSFKLSSVTAQDTAVYYCAR | 1C1 | 716 |
| RVTISKDTSKNQFSLKMSSLTAADTAVYYCAR | 1C1 | 717 |
| RVTISKDTSKNQFSLKMSSVQAADTAVYYCAR | 1C1 | 718 |
| RVTISKDTSKNQFSLKMSSVTAQDTAVYYCAR | 1C1 | 719 |
| RVTISKDTSKNQFSLKLSSLQAADTAVYYCAR | 1C1 | 720 |
| RVTISKDTSKNQFSLKLSSLTAQDTAVYYCAR | 1C1 | 721 |
| RVTISKDTSKNQFSLKLSSVQAQDTAVYYCAR | 1C1 | 722 |
| RVTISVDNSKQVSLKLSSVTAADTAVYYCAR | 1C1 | 723 |
| RVTISVDNSKSQFSFKLSSVTAADTAVYYCAR | 1C1 | 724 |
| RVTISVDNSKSQFSLKMSSVTAADTAVYYCAR | 1C1 | 725 |
| RVTISVDNSKSQFSLKLSSLTAADTAVYYCAR | 1C1 | 726 |
| RVTISVDNSKSQFSLKLSSVQAADTAVYYCAR | 1C1 | 727 |
| RVTISVDNSKSQFSLKLSSVTAQDTAVYYCAR | 1C1 | 728 |
| RVTISVDNSKNQVSFKLSSVTAADTAVYYCAR | 1C1 | 729 |

TABLE 25-continued

Exemplary Framework Sequences for Humanized Anti-GFRAL Antibodies

| | | |
|---|---|---|
| RVTISVDNSKNQVSLKMSSVTAADTAVYYCAR | 1C1 | 730 |
| RVTISVDNSKNQVSLKLSSLTAADTAVYYCAR | 1C1 | 731 |
| RVTISVDNSKNQVSLKLSSVQAADTAVYYCAR | 1C1 | 732 |
| RVTISVDNSKNQVSLKLSSVTAQDTAVYYCAR | 1C1 | 733 |
| RVTISVDNSKNQFSFKMSSVTAADTAVYYCAR | 1C1 | 734 |
| RVTISVDNSKNQFSFKLSSLTAADTAVYYCAR | 1C1 | 735 |
| RVTISVDNSKNQFSFKLSSVQAADTAVYYCAR | 1C1 | 736 |
| RVTISVDNSKNQFSFKLSSVTAQDTAVYYCAR | 1C1 | 737 |
| RVTISVDNSKNQFSLKMSSLTAADTAVYYCAR | 1C1 | 738 |
| RVTISVDNSKNQFSLKMSSVQAADTAVYYCAR | 1C1 | 739 |
| RVTISVDNSKNQFSLKMSSVTAQDTAVYYCAR | 1C1 | 740 |
| RVTISVDNSKNQFSLKLSSLQAADTAVYYCAR | 1C1 | 741 |
| RVTISVDNSKNQFSLKLSSLTAQDTAVYYCAR | 1C1 | 742 |
| RVTISVDNSKNQFSLKLSSVQAQDTAVYYCAR | 1C1 | 743 |
| RVTISVDTSKSQVSFKLSSVTAADTAVYYCAR | 1C1 | 744 |
| RVTISVDTSKSQVSLKMSSVTAADTAVYYCAR | 1C1 | 745 |
| RVTISVDTSKSQVSLKLSSLTAADTAVYYCAR | 1C1 | 746 |
| RVTISVDTSKSQVSLKLSSVQAADTAVYYCAR | 1C1 | 747 |
| RVTISVDTSKSQVSLKLSSVTAQDTAVYYCAR | 1C1 | 748 |
| RVTISVDTSKSQFSFKMSSVTAADTAVYYCAR | 1C1 | 749 |
| RVTISVDTSKSQFSFKLSSLTAADTAVYYCAR | 1C1 | 750 |
| RVTISVDTSKSQFSFKLSSVQAADTAVYYCAR | 1C1 | 751 |
| RVTISVDTSKSQFSFKLSSVTAQDTAVYYCAR | 1C1 | 752 |
| RVTISVDTSKSQFSLKMSSLTAADTAVYYCAR | 1C1 | 753 |
| RVTISVDTSKSQFSLKMSSVQAADTAVYYCAR | 1C1 | 754 |
| RVTISVDTSKSQFSLKMSSVTAQDTAVYYCAR | 1C1 | 755 |
| RVTISVDTSKSQFSLKLSSLQAADTAVYYCAR | 1C1 | 756 |
| RVTISVDTSKSQFSLKLSSLTAQDTAVYYCAR | 1C1 | 757 |
| RVTISVDTSKSQFSLKLSSVQAQDTAVYYCAR | 1C1 | 758 |
| RVTISVDTSKNQVSFKMSSVTAADTAVYYCAR | 1C1 | 759 |
| RVTISVDTSKNQVSFKLSSLTAADTAVYYCAR | 1C1 | 760 |
| RVTISVDTSKNQVSFKLSSVQAADTAVYYCAR | 1C1 | 761 |
| RVTISVDTSKNQVSFKLSSVTAQDTAVYYCAR | 1C1 | 762 |
| RVTISVDTSKNQVSLKMSSLTAADTAVYYCAR | 1C1 | 763 |
| RVTISVDTSKNQVSLKMSSVQAADTAVYYCAR | 1C1 | 764 |
| RVTISVDTSKNQVSLKMSSVTAQDTAVYYCAR | 1C1 | 765 |
| RVTISVDTSKNQVSLKLSSLQAADTAVYYCAR | 1C1 | 766 |
| RVTISVDTSKNQVSLKLSSLTAQDTAVYYCAR | 1C1 | 767 |
| RVTISVDTSKNQVSLKLSSVQAQDTAVYYCAR | 1C1 | 768 |

TABLE 25-continued

Exemplary Framework Sequences for Humanized Anti-GFRAL Antibodies

| | | |
|---|---|---|
| RVTISVDTSKNQFSFKMSSLTAADTAVYYCAR | 1C1 | 769 |
| RVTISVDTSKNQFSFKMSSVQAADTAVYYCAR | 1C1 | 770 |
| RVTISVDTSKNQFSFKMSSVTAQDTAVYYCAR | 1C1 | 771 |
| RVTISVDTSKNQFSFKLSSLQAADTAVYYCAR | 1C1 | 772 |
| RVTISVDTSKNQFSFKLSSLTAQDTAVYYCAR | 1C1 | 773 |
| RVTISVDTSKNQFSFKLSSVQAQDTAVYYCAR | 1C1 | 774 |
| RVTISVDTSKNQFSLKMSSLQAADTAVYYCAR | 1C1 | 775 |
| RVTISVDTSKNQFSLKMSSLTAQDTAVYYCAR | 1C1 | 776 |
| RVTISVDTSKNQFSLKMSSVQAQDTAVYYCAR | 1C1 | 777 |
| RVTISVDTSKNQFSLKLSSLQAQDTAVYYCAR | 1C1 | 778 |
| RLTISKDNSKSQFSLKLSSVTAADTAVYYCAR | 1C1 | 779 |
| RLTISKDNSKNQVSLKLSSVTAADTAVYYCAR | 1C1 | 780 |
| RLTISKDNSKNQFSFKLSSVTAADTAVYYCAR | 1C1 | 781 |
| RLTISKDNSKNQFSLKMSSVTAADTAVYYCAR | 1C1 | 782 |
| RLTISKDNSKNQFSLKLSSLTAADTAVYYCAR | 1C1 | 783 |
| RLTISKDNSKNQFSLKLSSVQAADTAVYYCAR | 1C1 | 784 |
| RLTISKDNSKNQFSLKLSSVTAQDTAVYYCAR | 1C1 | 785 |
| RLTISKDTSKSQVSLKLSSVTAADTAVYYCAR | 1C1 | 786 |
| RLTISKDTSKSQFSFKLSSVTAADTAVYYCAR | 1C1 | 787 |
| RLTISKDTSKSQFSLKMSSVTAADTAVYYCAR | 1C1 | 788 |
| RLTISKDTSKSQFSLKLSSLTAADTAVYYCAR | 1C1 | 789 |
| RLTISKDTSKSQFSLKLSSVQAADTAVYYCAR | 1C1 | 790 |
| RLTISKDTSKSQFSLKLSSVTAQDTAVYYCAR | 1C1 | 791 |
| RLTISKDTSKNQVSFKLSSVTAADTAVYYCAR | 1C1 | 792 |
| RLTISKDTSKNQVSLKMSSVTAADTAVYYCAR | 1C1 | 793 |
| RLTISKDTSKNQVSLKLSSLTAADTAVYYCAR | 1C1 | 794 |
| RLTISKDTSKNQVSLKLSSVQAADTAVYYCAR | 1C1 | 795 |
| RLTISKDTSKNQVSLKLSSVTAQDTAVYYCAR | 1C1 | 796 |
| RLTISKDTSKNQFSFKMSSVTAADTAVYYCAR | 1C1 | 797 |
| RLTISKDTSKNQFSFKLSSLTAADTAVYYCAR | 1C1 | 798 |
| RLTISKDTSKNQFSFKLSSVQAADTAVYYCAR | 1C1 | 799 |
| RLTISKDTSKNQFSFKLSSVTAQDTAVYYCAR | 1C1 | 800 |
| RLTISKDTSKNQFSLKMSSLTAADTAVYYCAR | 1C1 | 801 |
| RLTISKDTSKNQFSLKMSSVQAADTAVYYCAR | 1C1 | 802 |
| RLTISKDTSKNQFSLKMSSVTAQDTAVYYCAR | 1C1 | 803 |
| RLTISKDTSKNQFSLKLSSLQAADTAVYYCAR | 1C1 | 804 |
| RLTISKDTSKNQFSLKLSSLTAQDTAVYYCAR | 1C1 | 805 |
| RLTISKDTSKNQFSLKLSSVQAQDTAVYYCAR | 1C1 | 806 |
| RLTISVDNSKSQVSLKLSSVTAADTAVYYCAR | 1C1 | 807 |

TABLE 25-continued

Exemplary Framework Sequences for Humanized Anti-GFRAL Antibodies

| Sequence | Clone | SEQ ID NO |
|---|---|---|
| RLTISVDNSKSQFSFKLSSVTAADTAVYYCAR | 1C1 | 808 |
| RLTISVDNSKSQFSLKMSSVTAADTAVYYCAR | 1C1 | 809 |
| RLTISVDNSKSQFSLKLSSLTAADTAVYYCAR | 1C1 | 810 |
| RLTISVDNSKSQFSLKLSSVQAADTAVYYCAR | 1C1 | 811 |
| RLTISVDNSKSQFSLKLSSVTAQDTAVYYCAR | 1C1 | 812 |
| RLTISVDNSKNQVSFKLSSVTAADTAVYYCAR | 1C1 | 813 |
| RLTISVDNSKNQVSLKMSSVTAADTAVYYCAR | 1C1 | 814 |
| RLTISVDNSKNQVSLKLSSLTAADTAVYYCAR | 1C1 | 815 |
| RLTISVDNSKNQVSLKLSSVQAADTAVYYCAR | 1C1 | 816 |
| RLTISVDNSKNQVSLKLSSVTAQDTAVYYCAR | 1C1 | 817 |
| RLTISVDNSKNQFSFKMSSVTAADTAVYYCAR | 1C1 | 818 |
| RLTISVDNSKNQFSFKLSSLTAADTAVYYCAR | 1C1 | 819 |
| RLTISVDNSKNQFSFKLSSVQAADTAVYYCAR | 1C1 | 820 |
| RLTISVDNSKNQFSFKLSSVTAQDTAVYYCAR | 1C1 | 821 |
| RLTISVDNSKNQFSLKMSSLTAADTAVYYCAR | 1C1 | 822 |
| RLTISVDNSKNQFSLKMSSVQAADTAVYYCAR | 1C1 | 823 |
| RLTISVDNSKNQFSLKMSSVTAQDTAVYYCAR | 1C1 | 824 |
| RLTISVDNSKNQFSLKLSSLQAADTAVYYCAR | 1C1 | 825 |
| RLTISVDNSKNQFSLKLSSLTAQDTAVYYCAR | 1C1 | 826 |
| RLTISVDNSKNQFSLKLSSVQAQDTAVYYCAR | 1C1 | 827 |
| RLTISVDTSKSQVSFKLSSVTAADTAVYYCAR | 1C1 | 828 |
| RLTISVDTSKSQVSLKMSSVTAADTAVYYCAR | 1C1 | 829 |
| RLTISVDTSKSQVSLKLSSLTAADTAVYYCAR | 1C1 | 830 |
| RLTISVDTSKSQVSLKLSSVQAADTAVYYCAR | 1C1 | 831 |
| RLTISVDTSKSQVSLKLSSVTAQDTAVYYCAR | 1C1 | 832 |
| RLTISVDTSKSQFSFKMSSVTAADTAVYYCAR | 1C1 | 833 |
| RLTISVDTSKSQFSFKLSSLTAADTAVYYCAR | 1C1 | 834 |
| RLTISVDTSKSQFSFKLSSVQAADTAVYYCAR | 1C1 | 835 |
| RLTISVDTSKSQFSFKLSSVTAQDTAVYYCAR | 1C1 | 836 |
| RLTISVDTSKSQFSLKMSSLTAADTAVYYCAR | 1C1 | 837 |
| RLTISVDTSKSQFSLKMSSVQAADTAVYYCAR | 1C1 | 838 |
| RLTISVDTSKSQFSLKMSSVTAQDTAVYYCAR | 1C1 | 839 |
| RLTISVDTSKSQFSLKLSSLQAADTAVYYCAR | 1C1 | 840 |
| RLTISVDTSKSQFSLKLSSLTAQDTAVYYCAR | 1C1 | 841 |
| RLTISVDTSKSQFSLKLSSVQAQDTAVYYCAR | 1C1 | 842 |
| RLTISVDTSKNQVSFKMSSVTAADTAVYYCAR | 1C1 | 843 |
| RLTISVDTSKNQVSFKLSSLTAADTAVYYCAR | 1C1 | 844 |
| RLTISVDTSKNQVSFKLSSVQAADTAVYYCAR | 1C1 | 845 |
| RLTISVDTSKNQVSFKLSSVTAQDTAVYYCAR | 1C1 | 846 |

TABLE 25-continued

Exemplary Framework Sequences for Humanized Anti-GFRAL Antibodies

| Sequence | Clone | SEQ ID NO |
|---|---|---|
| RLTISVDTSKNQVSLKMSSLTAADTAVYYCAR | 1C1 | 847 |
| RLTISVDTSKNQVSLKMSSVQAADTAVYYCAR | 1C1 | 848 |
| RLTISVDTSKNQVSLKMSSVTAQDTAVYYCAR | 1C1 | 849 |
| RLTISVDTSKNQVSLKLSSLQAADTAVYYCAR | 1C1 | 850 |
| RLTISVDTSKNQVSLKLSSLTAQDTAVYYCAR | 1C1 | 851 |
| RLTISVDTSKNQVSLKLSSVQAQDTAVYYCAR | 1C1 | 852 |
| RLTISVDTSKNQFSFKMSSLTAADTAVYYCAR | 1C1 | 853 |
| RLTISVDTSKNQFSFKMSSVQAADTAVYYCAR | 1C1 | 854 |
| RLTISVDTSKNQFSFKMSSVTAQDTAVYYCAR | 1C1 | 855 |
| RLTISVDTSKNQFSFKLSSLQAADTAVYYCAR | 1C1 | 856 |
| RLTISVDTSKNQFSFKLSSLTAQDTAVYYCAR | 1C1 | 857 |
| RLTISVDTSKNQFSFKLSSVQAQDTAVYYCAR | 1C1 | 858 |
| RLTISVDTSKNQFSLKMSSLQAADTAVYYCAR | 1C1 | 859 |
| RLTISVDTSKNQFSLKMSSLTAQDTAVYYCAR | 1C1 | 860 |
| RLTISVDTSKNQFSLKMSSVQAQDTAVYYCAR | 1C1 | 861 |
| RLTISVDTSKNQFSLKLSSLQAQDTAVYYCAR | 1C1 | 862 |
| RVTISKDNSKSQVSLKLSSVTAADTAVYYCAR | 1C1 | 863 |
| RVTISKDNSKSQFSFKLSSVTAADTAVYYCAR | 1C1 | 864 |
| RVTISKDNSKSQFSLKMSSVTAADTAVYYCAR | 1C1 | 865 |
| RVTISKDNSKSQFSLKLSSLTAADTAVYYCAR | 1C1 | 866 |
| RVTISKDNSKSQFSLKLSSVQAADTAVYYCAR | 1C1 | 867 |
| RVTISKDNSKSQFSLKLSSVTAQDTAVYYCAR | 1C1 | 868 |
| RVTISKDNSKNQVSFKLSSVTAADTAVYYCAR | 1C1 | 869 |
| RVTISKDNSKNQVSLKMSSVTAADTAVYYCAR | 1C1 | 870 |
| RVTISKDNSKNQVSLKLSSLTAADTAVYYCAR | 1C1 | 871 |
| RVTISKDNSKNQVSLKLSSVQAADTAVYYCAR | 1C1 | 872 |
| RVTISKDNSKNQVSLKLSSVTAQDTAVYYCAR | 1C1 | 873 |
| RVTISKDNSKNQFSFKMSSVTAADTAVYYCAR | 1C1 | 874 |
| RVTISKDNSKNQFSFKLSSLTAADTAVYYCAR | 1C1 | 875 |
| RVTISKDNSKNQFSFKLSSVQAADTAVYYCAR | 1C1 | 876 |
| RVTISKDNSKNQFSFKLSSVTAQDTAVYYCAR | 1C1 | 877 |
| RVTISKDNSKNQFSLKMSSLTAADTAVYYCAR | 1C1 | 878 |
| RVTISKDNSKNQFSLKMSSVQAADTAVYYCAR | 1C1 | 879 |
| RVTISKDNSKNQFSLKMSSVTAQDTAVYYCAR | 1C1 | 880 |
| RVTISKDNSKNQFSLKLSSLQAADTAVYYCAR | 1C1 | 881 |
| RVTISKDNSKNQFSLKLSSLTAQDTAVYYCAR | 1C1 | 882 |
| RVTISKDNSKNQFSLKLSSVQAQDTAVYYCAR | 1C1 | 883 |
| RVTISKDTSKSQVSFKLSSVTAADTAVYYCAR | 1C1 | 884 |
| RVTISKDTSKSQVSLKMSSVTAADTAVYYCAR | 1C1 | 885 |

TABLE 25-continued

Exemplary Framework Sequences for Humanized
Anti-GFRAL Antibodies

| Sequence | Label | SEQ ID |
|---|---|---|
| RVTISKDTSKSQVSLKLSSLTAADTAVYYCAR | 1C1 | 886 |
| RVTISKDTSKSQVSLKLSSVQAADTAVYYCAR | 1C1 | 887 |
| RVTISKDTSKSQVSLKLSSVTAQDTAVYYCAR | 1C1 | 888 |
| RVTISKDTSKSQFSFKMSSVTAADTAVYYCAR | 1C1 | 889 |
| RVTISKDTSKSQFSFKLSSLTAADTAVYYCAR | 1C1 | 890 |
| RVTISKDTSKSQFSFKLSSVQAADTAVYYCAR | 1C1 | 891 |
| RVTISKDTSKSQFSFKLSSVTAQDTAVYYCAR | 1C1 | 892 |
| RVTISKDTSKSQFSLKMSSLTAADTAVYYCAR | 1C1 | 893 |
| RVTISKDTSKSQFSLKMSSVQAADTAVYYCAR | 1C1 | 894 |
| RVTISKDTSKSQFSLKMSSVTAQDTAVYYCAR | 1C1 | 895 |
| RVTISKDTSKSQFSLKLSSLQAADTAVYYCAR | 1C1 | 896 |
| RVTISKDTSKSQFSLKLSSLTAQDTAVYYCAR | 1C1 | 897 |
| RVTISKDTSKSQFSLKLSSVQAQDTAVYYCAR | 1C1 | 898 |
| RVTISKDTSKNQVSFKMSSVTAADTAVYYCAR | 1C1 | 899 |
| RVTISKDTSKNQVSFKLSSLTAADTAVYYCAR | 1C1 | 900 |
| RVTISKDTSKNQVSFKLSSVQAADTAVYYCAR | 1C1 | 901 |
| RVTISKDTSKNQVSFKLSSVTAQDTAVYYCAR | 1C1 | 902 |
| RVTISKDTSKNQVSLKMSSLTAADTAVYYCAR | 1C1 | 903 |
| RVTISKDTSKNQVSLKMSSVQAADTAVYYCAR | 1C1 | 904 |
| RVTISKDTSKNQVSLKMSSVTAQDTAVYYCAR | 1C1 | 905 |
| RVTISKDTSKNQVSLKLSSLQAADTAVYYCAR | 1C1 | 906 |
| RVTISKDTSKNQVSLKLSSLTAQDTAVYYCAR | 1C1 | 907 |
| RVTISKDTSKNQVSLKLSSVQAQDTAVYYCAR | 1C1 | 908 |
| RVTISKDTSKNQFSFKMSSLTAADTAVYYCAR | 1C1 | 909 |
| RVTISKDTSKNQFSFKMSSVQAADTAVYYCAR | 1C1 | 910 |
| RVTISKDTSKNQFSFKMSSVTAQDTAVYYCAR | 1C1 | 911 |
| RVTISKDTSKNQFSFKLSSLQAADTAVYYCAR | 1C1 | 912 |
| RVTISKDTSKNQFSFKLSSLTAQDTAVYYCAR | 1C1 | 913 |
| RVTISKDTSKNQFSFKLSSVQAQDTAVYYCAR | 1C1 | 914 |
| RVTISKDTSKNQFSLKMSSLQAADTAVYYCAR | 1C1 | 915 |
| RVTISKDTSKNQFSLKMSSLTAQDTAVYYCAR | 1C1 | 916 |
| RVTISKDTSKNQFSLKMSSVQAQDTAVYYCAR | 1C1 | 917 |
| RVTISKDTSKNQFSLKLSSLQAQDTAVYYCAR | 1C1 | 918 |
| RVTISVDNSKSQVSFKLSSVTAADTAVYYCAR | 1C1 | 919 |
| RVTISVDNSKSQVSLKMSSVTAADTAVYYCAR | 1C1 | 920 |
| RVTISVDNSKSQVSLKLSSLTAADTAVYYCAR | 1C1 | 921 |
| RVTISVDNSKSQVSLKLSSVQAADTAVYYCAR | 1C1 | 922 |
| RVTISVDNSKSQVSLKLSSVTAQDTAVYYCAR | 1C1 | 923 |
| RVTISVDNSKSQFSFKMSSVTAADTAVYYCAR | 1C1 | 924 |

TABLE 25-continued

Exemplary Framework Sequences for Humanized Anti-GFRAL Antibodies

| Sequence | Clone | SEQ ID |
|---|---|---|
| RVTISVDNSKSQFSFKLSSLTAADTAVYYCAR | 1C1 | 925 |
| RVTISVDNSKSQFSFKLSSVQAADTAVYYCAR | 1C1 | 926 |
| RVTISVDNSKSQFSFKLSSVTAQDTAVYYCAR | 1C1 | 927 |
| RVTISVDNSKSQFSLKMSSLTAADTAVYYCAR | 1C1 | 928 |
| RVTISVDNSKSQFSLKMSSVQAADTAVYYCAR | 1C1 | 929 |
| RVTISVDNSKSQFSLKMSSVTAQDTAVYYCAR | 1C1 | 930 |
| RVTISVDNSKSQFSLKLSSLQAADTAVYYCAR | 1C1 | 931 |
| RVTISVDNSKSQFSLKLSSLTAQDTAVYYCAR | 1C1 | 932 |
| RVTISVDNSKSQFSLKLSSVQAQDTAVYYCAR | 1C1 | 933 |
| RVTISVDNSKNQVSFKMSSVTAADTAVYYCAR | 1C1 | 934 |
| RVTISVDNSKNQVSFKLSSLTAADTAVYYCAR | 1C1 | 935 |
| RVTISVDNSKNQVSFKLSSVQAADTAVYYCAR | 1C1 | 936 |
| RVTISVDNSKNQVSFKLSSVTAQDTAVYYCAR | 1C1 | 937 |
| RVTISVDNSKNQVSLKMSSLTAADTAVYYCAR | 1C1 | 938 |
| RVTISVDNSKNQVSLKMSSVQAADTAVYYCAR | 1C1 | 939 |
| RVTISVDNSKNQVSLKMSSVTAQDTAVYYCAR | 1C1 | 940 |
| RVTISVDNSKNQVSLKLSSLQAADTAVYYCAR | 1C1 | 941 |
| RVTISVDNSKNQVSLKLSSLTAQDTAVYYCAR | 1C1 | 942 |
| RVTISVDNSKNQVSLKLSSVQAQDTAVYYCAR | 1C1 | 943 |
| RVTISVDNSKNQFSFKMSSLTAADTAVYYCAR | 1C1 | 944 |
| RVTISVDNSKNQFSFKMSSVQAADTAVYYCAR | 1C1 | 945 |
| RVTISVDNSKNQFSFKMSSVTAQDTAVYYCAR | 1C1 | 946 |
| RVTISVDNSKNQFSFKLSSLQAADTAVYYCAR | 1C1 | 947 |
| RVTISVDNSKNQFSFKLSSLTAQDTAVYYCAR | 1C1 | 948 |
| RVTISVDNSKNQFSFKLSSVQAQDTAVYYCAR | 1C1 | 949 |
| RVTISVDNSKNQFSLKMSSLQAADTAVYYCAR | 1C1 | 950 |
| RVTISVDNSKNQFSLKMSSLTAQDTAVYYCAR | 1C1 | 951 |
| RVTISVDNSKNQFSLKMSSVQAQDTAVYYCAR | 1C1 | 952 |
| RVTISVDNSKNQFSLKLSSLQAQDTAVYYCAR | 1C1 | 953 |
| RVTISVDTSKSQVSFKMSSVTAADTAVYYCAR | 1C1 | 954 |
| RVTISVDTSKSQVSFKLSSLTAADTAVYYCAR | 1C1 | 955 |
| RVTISVDTSKSQVSFKLSSVQAADTAVYYCAR | 1C1 | 956 |
| RVTISVDTSKSQVSFKLSSVTAQDTAVYYCAR | 1C1 | 957 |
| RVTISVDTSKSQVSLKMSSLTAADTAVYYCAR | 1C1 | 958 |
| RVTISVDTSKSQVSLKMSSVQAADTAVYYCAR | 1C1 | 959 |
| RVTISVDTSKSQVSLKMSSVTAQDTAVYYCAR | 1C1 | 960 |
| RVTISVDTSKSQVSLKLSSLQAADTAVYYCAR | 1C1 | 961 |
| RVTISVDTSKSQVSLKLSSLTAQDTAVYYCAR | 1C1 | 962 |
| RVTISVDTSKSQVSLKLSSVQAQDTAVYYCAR | 1C1 | 963 |

TABLE 25-continued

Exemplary Framework Sequences for Humanized Anti-GFRAL Antibodies

| | | |
|---|---|---|
| RVTISVDTSKSQFSFKMSSLTAADTAVYYCAR | 1C1 | 964 |
| RVTISVDTSKSQFSFKMSSVQAADTAVYYCAR | 1C1 | 965 |
| RVTISVDTSKSQFSFKMSSVTAQDTAVYYCAR | 1C1 | 966 |
| RVTISVDTSKSQFSFKLSSLQAADTAVYYCAR | 1C1 | 967 |
| RVTISVDTSKSQFSFKLSSLTAQDTAVYYCAR | 1C1 | 968 |
| RVTISVDTSKSQFSFKLSSVQAQDTAVYYCAR | 1C1 | 969 |
| RVTISVDTSKSQFSLKMSSLQAADTAVYYCAR | 1C1 | 970 |
| RVTISVDTSKSQFSLKMSSLTAQDTAVYYCAR | 1C1 | 971 |
| RVTISVDTSKSQFSLKMSSVQAQDTAVYYCAR | 1C1 | 972 |
| RVTISVDTSKSQFSLKLSSLQAQDTAVYYCAR | 1C1 | 973 |
| RVTISVDTSKNQVSFKMSSLTAADTAVYYCAR | 1C1 | 974 |
| RVTISVDTSKNQVSFKMSSVQAADTAVYYCAR | 1C1 | 975 |
| RVTISVDTSKNQVSFKMSSVTAQDTAVYYCAR | 1C1 | 976 |
| RVTISVDTSKNQVSFKLSSLQAADTAVYYCAR | 1C1 | 977 |
| RVTISVDTSKNQVSFKLSSLTAQDTAVYYCAR | 1C1 | 978 |
| RVTISVDTSKNQVSFKLSSVQAQDTAVYYCAR | 1C1 | 979 |
| RVTISVDTSKNQVSLKMSSLQAADTAVYYCAR | 1C1 | 980 |
| RVTISVDTSKNQVSLKMSSLTAQDTAVYYCAR | 1C1 | 981 |
| RVTISVDTSKNQVSLKMSSVQAQDTAVYYCAR | 1C1 | 982 |
| RVTISVDTSKNQVSLKLSSLQAQDTAVYYCAR | 1C1 | 983 |
| RVTISVDTSKNQFSFKMSSLQAADTAVYYCAR | 1C1 | 984 |
| RVTISVDTSKNQFSFKMSSLTAQDTAVYYCAR | 1C1 | 985 |
| RVTISVDTSKNQFSFKMSSVQAQDTAVYYCAR | 1C1 | 986 |
| RVTISVDTSKNQFSFKLSSLQAQDTAVYYCAR | 1C1 | 987 |
| RVTISVDTSKNQFSLKMSSLQAQDTAVYYCAR | 1C1 | 988 |
| RLTISKDNSKSQVSLKLSSVTAADTAVYYCAR | 1C1 | 989 |
| RLTISKDNSKSQFSFKLSSVTAADTAVYYCAR | 1C1 | 990 |
| RLTISKDNSKSQFSLKMSSVTAADTAVYYCAR | 1C1 | 991 |
| RLTISKDNSKSQFSLKLSSLTAADTAVYYCAR | 1C1 | 992 |
| RLTISKDNSKSQFSLKLSSVQAADTAVYYCAR | 1C1 | 993 |
| RLTISKDNSKSQFSLKLSSVTAQDTAVYYCAR | 1C1 | 994 |
| RLTISKDNSKNQVSFKLSSVTAADTAVYYCAR | 1C1 | 995 |
| RLTISKDNSKNQVSLKMSSVTAADTAVYYCAR | 1C1 | 996 |
| RLTISKDNSKNQVSLKLSSLTAADTAVYYCAR | 1C1 | 997 |
| RLTISKDNSKNQVSLKLSSVQAADTAVYYCAR | 1C1 | 998 |
| RLTISKDNSKNQVSLKLSSVTAQDTAVYYCAR | 1C1 | 999 |
| RLTISKDNSKNQFSFKMSSVTAADTAVYYCAR | 1C1 | 1000 |
| RLTISKDNSKNQFSFKLSSLTAADTAVYYCAR | 1C1 | 1001 |
| RLTISKDNSKNQFSFKLSSVQAADTAVYYCAR | 1C1 | 1002 |

TABLE 25-continued

Exemplary Framework Sequences for Humanized Anti-GFRAL Antibodies

| | | |
|---|---|---|
| RLTISKDNSKNQFSFKLSSVTAQDTAVYYCAR | 1C1 | 1003 |
| RLTISKDNSKNQFSLKMSSLTAADTAVYYCAR | 1C1 | 1004 |
| RLTISKDNSKNQFSLKMSSVQAADTAVYYCAR | 1C1 | 1005 |
| RLTISKDNSKNQFSLKMSSVTAQDTAVYYCAR | 1C1 | 1006 |
| RLTISKDNSKNQFSLKLSSLQAADTAVYYCAR | 1C1 | 1007 |
| RLTISKDNSKNQFSLKLSSLTAQDTAVYYCAR | 1C1 | 1008 |
| RLTISKDNSKNQFSLKLSSVQAQDTAVYYCAR | 1C1 | 1009 |
| RLTISKDTSKSQVSFKLSSVTAADTAVYYCAR | 1C1 | 1010 |
| RLTISKDTSKSQVSLKMSSVTAADTAVYYCAR | 1C1 | 1011 |
| RLTISKDTSKSQVSLKLSSLTAADTAVYYCAR | 1C1 | 1012 |
| RLTISKDTSKSQVSLKLSSVQAADTAVYYCAR | 1C1 | 1013 |
| RLTISKDTSKSQVSLKLSSVTAQDTAVYYCAR | 1C1 | 1014 |
| RLTISKDTSKSQFSFKMSSVTAADTAVYYCAR | 1C1 | 1015 |
| RLTISKDTSKSQFSFKLSSLTAADTAVYYCAR | 1C1 | 1016 |
| RLTISKDTSKSQFSFKLSSVQAADTAVYYCAR | 1C1 | 1017 |
| RLTISKDTSKSQFSFKLSSVTAQDTAVYYCAR | 1C1 | 1018 |
| RLTISKDTSKSQFSLKMSSLTAADTAVYYCAR | 1C1 | 1019 |
| RLTISKDTSKSQFSLKMSSVQAADTAVYYCAR | 1C1 | 1020 |
| RLTISKDTSKSQFSLKMSSVTAQDTAVYYCAR | 1C1 | 1021 |
| RLTISKDTSKSQFSLKLSSLQAADTAVYYCAR | 1C1 | 1022 |
| RLTISKDTSKSQFSLKLSSLTAQDTAVYYCAR | 1C1 | 1023 |
| RLTISKDTSKSQFSLKLSSVQAQDTAVYYCAR | 1C1 | 1024 |
| RLTISKDTSKNQVSFKMSSVTAADTAVYYCAR | 1C1 | 1025 |
| RLTISKDTSKNQVSFKLSSLTAADTAVYYCAR | 1C1 | 1026 |
| RLTISKDTSKNQVSFKLSSVQAADTAVYYCAR | 1C1 | 1027 |
| RLTISKDTSKNQVSFKLSSVTAQDTAVYYCAR | 1C1 | 1028 |
| RLTISKDTSKNQVSLKMSSLTAADTAVYYCAR | 1C1 | 1029 |
| RLTISKDTSKNQVSLKMSSVQAADTAVYYCAR | 1C1 | 1030 |
| RLTISKDTSKNQVSLKMSSVTAQDTAVYYCAR | 1C1 | 1031 |
| RLTISKDTSKNQVSLKLSSLQAADTAVYYCAR | 1C1 | 1032 |
| RLTISKDTSKNQVSLKLSSLTAQDTAVYYCAR | 1C1 | 1033 |
| RLTISKDTSKNQVSLKLSSVQAQDTAVYYCAR | 1C1 | 1034 |
| RLTISKDTSKNQFSFKMSSLTAADTAVYYCAR | 1C1 | 1035 |
| RLTISKDTSKNQFSFKMSSVQAADTAVYYCAR | 1C1 | 1036 |
| RLTISKDTSKNQFSFKMSSVTAQDTAVYYCAR | 1C1 | 1037 |
| RLTISKDTSKNQFSFKLSSLQAADTAVYYCAR | 1C1 | 1038 |
| RLTISKDTSKNQFSFKLSSLTAQDTAVYYCAR | 1C1 | 1039 |
| RLTISKDTSKNQFSFKLSSVQAQDTAVYYCAR | 1C1 | 1040 |
| RLTISKDTSKNQFSLKMSSLQAADTAVYYCAR | 1C1 | 1041 |

TABLE 25-continued

Exemplary Framework Sequences for Humanized Anti-GFRAL Antibodies

| Sequence | Clone | SEQ ID NO |
|---|---|---|
| RLTISKDTSKNQFSLKMSSLTAQDTAVYYCAR | 1C1 | 1042 |
| RLTISKDTSKNQFSLKMSSVQAQDTAVYYCAR | 1C1 | 1043 |
| RLTISKDTSKNQFSLKLSSLQAQDTAVYYCAR | 1C1 | 1044 |
| RLTISVDNSKSQVSFKLSSVTAADTAVYYCAR | 1C1 | 1045 |
| RLTISVDNSKSQVSLKMSSVTAADTAVYYCAR | 1C1 | 1046 |
| RLTISVDNSKSQVSLKLSSLTAADTAVYYCAR | 1C1 | 1047 |
| RLTISVDNSKSQVSLKLSSVQAADTAVYYCAR | 1C1 | 1048 |
| RLTISVDNSKSQVSLKLSSVTAQDTAVYYCAR | 1C1 | 1049 |
| RLTISVDNSKSQFSFKMSSVTAADTAVYYCAR | 1C1 | 1050 |
| RLTISVDNSKSQFSFKLSSLTAADTAVYYCAR | 1C1 | 1051 |
| RLTISVDNSKSQFSFKLSSVQAADTAVYYCAR | 1C1 | 1052 |
| RLTISVDNSKSQFSFKLSSVTAQDTAVYYCAR | 1C1 | 1053 |
| RLTISVDNSKSQFSLKMSSLTAADTAVYYCAR | 1C1 | 1054 |
| RLTISVDNSKSQFSLKMSSVQAADTAVYYCAR | 1C1 | 1055 |
| RLTISVDNSKSQFSLKMSSVTAQDTAVYYCAR | 1C1 | 1056 |
| RLTISVDNSKSQFSLKLSSLQAADTAVYYCAR | 1C1 | 1057 |
| RLTISVDNSKSQFSLKLSSLTAQDTAVYYCAR | 1C1 | 1058 |
| RLTISVDNSKSQFSLKLSSVQAQDTAVYYCAR | 1C1 | 1059 |
| RLTISVDNSKNQVSFKMSSVTAADTAVYYCAR | 1C1 | 1060 |
| RLTISVDNSKNQVSFKLSSLTAADTAVYYCAR | 1C1 | 1061 |
| RLTISVDNSKNQVSFKLSSVQAADTAVYYCAR | 1C1 | 1062 |
| RLTISVDNSKNQVSFKLSSVTAQDTAVYYCAR | 1C1 | 1063 |
| RLTISVDNSKNQVSLKMSSLTAADTAVYYCAR | 1C1 | 1064 |
| RLTISVDNSKNQVSLKMSSVQAADTAVYYCAR | 1C1 | 1065 |
| RLTISVDNSKNQVSLKMSSVTAQDTAVYYCAR | 1C1 | 1066 |
| RLTISVDNSKNQVSLKLSSLQAADTAVYYCAR | 1C1 | 1067 |
| RLTISVDNSKNQVSLKLSSLTAQDTAVYYCAR | 1C1 | 1068 |
| RLTISVDNSKNQVSLKLSSVQAQDTAVYYCAR | 1C1 | 1069 |
| RLTISVDNSKNQFSFKMSSLTAADTAVYYCAR | 1C1 | 1070 |
| RLTISVDNSKNQFSFKMSSVQAADTAVYYCAR | 1C1 | 1071 |
| RLTISVDNSKNQFSFKMSSVTAQDTAVYYCAR | 1C1 | 1072 |
| RLTISVDNSKNQFSFKLSSLQAADTAVYYCAR | 1C1 | 1073 |
| RLTISVDNSKNQFSFKLSSLTAQDTAVYYCAR | 1C1 | 1074 |
| RLTISVDNSKNQFSFKLSSVQAQDTAVYYCAR | 1C1 | 1075 |
| RLTISVDNSKNQFSLKMSSLQAADTAVYYCAR | 1C1 | 1076 |
| RLTISVDNSKNQFSLKMSSLTAQDTAVYYCAR | 1C1 | 1077 |
| RLTISVDNSKNQFSLKMSSVQAQDTAVYYCAR | 1C1 | 1078 |
| RLTISVDNSKNQFSLKLSSLQAQDTAVYYCAR | 1C1 | 1079 |
| RLTISVDTSKSQVSFKMSSVTAADTAVYYCAR | 1C1 | 1080 |

TABLE 25-continued

Exemplary Framework Sequences for Humanized Anti-GFRAL Antibodies

| | | |
|---|---|---|
| RLTISVDTSKSQVSFKLSSLTAADTAVYYCAR | 1C1 | 1081 |
| RLTISVDTSKSQVSFKLSSVQAADTAVYYCAR | 1C1 | 1082 |
| RLTISVDTSKSQVSFKLSSVTAQDTAVYYCAR | 1C1 | 1083 |
| RLTISVDTSKSQVSLKMSSLTAADTAVYYCAR | 1C1 | 1084 |
| RLTISVDTSKSQVSLKMSSVQAADTAVYYCAR | 1C1 | 1085 |
| RLTISVDTSKSQVSLKMSSVTAQDTAVYYCAR | 1C1 | 1086 |
| RLTISVDTSKSQVSLKLSSLQAADTAVYYCAR | 1C1 | 1087 |
| RLTISVDTSKSQVSLKLSSLTAQDTAVYYCAR | 1C1 | 1088 |
| RLTISVDTSKSQVSLKLSSVQAQDTAVYYCAR | 1C1 | 1089 |
| RLTISVDTSKSQFSFKMSSLTAADTAVYYCAR | 1C1 | 1090 |
| RLTISVDTSKSQFSFKMSSVQAADTAVYYCAR | 1C1 | 1091 |
| RLTISVDTSKSQFSFKMSSVTAQDTAVYYCAR | 1C1 | 1092 |
| RLTISVDTSKSQFSFKLSSLQAADTAVYYCAR | 1C1 | 1093 |
| RLTISVDTSKSQFSFKLSSLTAQDTAVYYCAR | 1C1 | 1094 |
| RLTISVDTSKSQFSFKLSSVQAQDTAVYYCAR | 1C1 | 1095 |
| RLTISVDTSKSQFSLKMSSLQAADTAVYYCAR | 1C1 | 1096 |
| RLTISVDTSKSQFSLKMSSLTAQDTAVYYCAR | 1C1 | 1097 |
| RLTISVDTSKSQFSLKMSSVQAQDTAVYYCAR | 1C1 | 1098 |
| RLTISVDTSKSQFSLKLSSLQAQDTAVYYCAR | 1C1 | 1099 |
| RLTISVDTSKNQVSFKMSSLTAADTAVYYCAR | 1C1 | 1100 |
| RLTISVDTSKNQVSFKMSSVQAADTAVYYCAR | 1C1 | 1101 |
| RLTISVDTSKNQVSFKMSSVTAQDTAVYYCAR | 1C1 | 1102 |
| RLTISVDTSKNQVSFKLSSLQAADTAVYYCAR | 1C1 | 1103 |
| RLTISVDTSKNQVSFKLSSLTAQDTAVYYCAR | 1C1 | 1104 |
| RLTISVDTSKNQVSFKLSSVQAQDTAVYYCAR | 1C1 | 1105 |
| RLTISVDTSKNQVSLKMSSLQAADTAVYYCAR | 1C1 | 1106 |
| RLTISVDTSKNQVSLKMSSLTAQDTAVYYCAR | 1C1 | 1107 |
| RLTISVDTSKNQVSLKMSSVQAQDTAVYYCAR | 1C1 | 1108 |
| RLTISVDTSKNQVSLKLSSLQAQDTAVYYCAR | 1C1 | 1109 |
| RLTISVDTSKNQFSFKMSSLQAADTAVYYCAR | 1C1 | 1110 |
| RLTISVDTSKNQFSFKMSSLTAQDTAVYYCAR | 1C1 | 1111 |
| RLTISVDTSKNQFSFKMSSVQAQDTAVYYCAR | 1C1 | 1112 |
| RLTISVDTSKNQFSFKLSSLQAQDTAVYYCAR | 1C1 | 1113 |
| RLTISVDTSKNQFSLKMSSLQAQDTAVYYCAR | 1C1 | 1114 |
| RVTISKDNSKSQVSFKLSSVTAADTAVYYCAR | 1C1 | 1115 |
| RVTISKDNSKSQVSLKMSSVTAADTAVYYCAR | 1C1 | 1116 |
| RVTISKDNSKSQVSLKLSSLTAADTAVYYCAR | 1C1 | 1117 |
| RVTISKDNSKSQVSLKLSSVQAADTAVYYCAR | 1C1 | 1118 |
| RVTISKDNSKSQVSLKLSSVTAQDTAVYYCAR | 1C1 | 1119 |

TABLE 25-continued

Exemplary Framework Sequences for Humanized Anti-GFRAL Antibodies

| | | |
|---|---|---|
| RVTISKDNSKSQFSFKMSSVTAADTAVYYCAR | 1C1 | 1120 |
| RVTISKDNSKSQFSFKLSSLTAADTAVYYCAR | 1C1 | 1121 |
| RVTISKDNSKSQFSFKLSSVQAADTAVYYCAR | 1C1 | 1122 |
| RVTISKDNSKSQFSFKLSSVTAQDTAVYYCAR | 1C1 | 1123 |
| RVTISKDNSKSQFSLKMSSLTAADTAVYYCAR | 1C1 | 1124 |
| RVTISKDNSKSQFSLKMSSVQAADTAVYYCAR | 1C1 | 1125 |
| RVTISKDNSKSQFSLKMSSVTAQDTAVYYCAR | 1C1 | 1126 |
| RVTISKDNSKSQFSLKLSSLQAADTAVYYCAR | 1C1 | 1127 |
| RVTISKDNSKSQFSLKLSSLTAQDTAVYYCAR | 1C1 | 1128 |
| RVTISKDNSKSQFSLKLSSVQAQDTAVYYCAR | 1C1 | 1129 |
| RVTISKDNSKNQVSFKMSSVTAADTAVYYCAR | 1C1 | 1130 |
| RVTISKDNSKNQVSFKLSSLTAADTAVYYCAR | 1C1 | 1131 |
| RVTISKDNSKNQVSFKLSSVQAADTAVYYCAR | 1C1 | 1132 |
| RVTISKDNSKNQVSFKLSSVTAQDTAVYYCAR | 1C1 | 1133 |
| RVTISKDNSKNQVSLKMSSLTAADTAVYYCAR | 1C1 | 1134 |
| RVTISKDNSKNQVSLKMSSVQAADTAVYYCAR | 1C1 | 1135 |
| RVTISKDNSKNQVSLKMSSVTAQDTAVYYCAR | 1C1 | 1136 |
| RVTISKDNSKNQVSLKLSSLQAADTAVYYCAR | 1C1 | 1137 |
| RVTISKDNSKNQVSLKLSSLTAQDTAVYYCAR | 1C1 | 1138 |
| RVTISKDNSKNQVSLKLSSVQAQDTAVYYCAR | 1C1 | 1139 |
| RVTISKDNSKNQFSFKMSSLTAADTAVYYCAR | 1C1 | 1140 |
| RVTISKDNSKNQFSFKMSSVQAADTAVYYCAR | 1C1 | 1141 |
| RVTISKDNSKNQFSFKMSSVTAQDTAVYYCAR | 1C1 | 1142 |
| RVTISKDNSKNQFSFKLSSLQAADTAVYYCAR | 1C1 | 1143 |
| RVTISKDNSKNQFSFKLSSLTAQDTAVYYCAR | 1C1 | 1144 |
| RVTISKDNSKNQFSFKLSSVQAQDTAVYYCAR | 1C1 | 1145 |
| RVTISKDNSKNQFSLKMSSLQAADTAVYYCAR | 1C1 | 1146 |
| RVTISKDNSKNQFSLKMSSLTAQDTAVYYCAR | 1C1 | 1147 |
| RVTISKDNSKNQFSLKMSSVQAQDTAVYYCAR | 1C1 | 1148 |
| RVTISKDNSKNQFSLKLSSLQAQDTAVYYCAR | 1C1 | 1149 |
| RVTISKDTSKSQVSFKMSSVTAADTAVYYCAR | 1C1 | 1150 |
| RVTISKDTSKSQVSFKLSSLTAADTAVYYCAR | 1C1 | 1151 |
| RVTISKDTSKSQVSFKLSSVQAADTAVYYCAR | 1C1 | 1152 |
| RVTISKDTSKSQVSFKLSSVTAQDTAVYYCAR | 1C1 | 1153 |
| RVTISKDTSKSQVSLKMSSLTAADTAVYYCAR | 1C1 | 1154 |
| RVTISKDTSKSQVSLKMSSVQAADTAVYYCAR | 1C1 | 1155 |
| RVTISKDTSKSQVSLKMSSVTAQDTAVYYCAR | 1C1 | 1156 |
| RVTISKDTSKSQVSLKLSSLQAADTAVYYCAR | 1C1 | 1157 |
| RVTISKDTSKSQVSLKLSSLTAQDTAVYYCAR | 1C1 | 1158 |

TABLE 25-continued

Exemplary Framework Sequences for Humanized Anti-GFRAL Antibodies

| | | |
|---|---|---|
| RVTISKDTSKSQVSLKLSSVQAQDTAVYYCAR | 1C1 | 1159 |
| RVTISKDTSKSQFSFKMSSLTAADTAVYYCAR | 1C1 | 1160 |
| RVTISKDTSKSQFSFKMSSVQAADTAVYYCAR | 1C1 | 1161 |
| RVTISKDTSKSQFSFKMSSVTAQDTAVYYCAR | 1C1 | 1162 |
| RVTISKDTSKSQFSFKLSSLQAADTAVYYCAR | 1C1 | 1163 |
| RVTISKDTSKSQFSFKLSSLTAQDTAVYYCAR | 1C1 | 1164 |
| RVTISKDTSKSQFSFKLSSVQAQDTAVYYCAR | 1C1 | 1165 |
| RVTISKDTSKSQFSLKMSSLQAADTAVYYCAR | 1C1 | 1166 |
| RVTISKDTSKSQFSLKMSSLTAQDTAVYYCAR | 1C1 | 1167 |
| RVTISKDTSKSQFSLKMSSVQAQDTAVYYCAR | 1C1 | 1168 |
| RVTISKDTSKSQFSLKLSSLQAQDTAVYYCAR | 1C1 | 1169 |
| RVTISKDTSKNQVSFKMSSLTAADTAVYYCAR | 1C1 | 1170 |
| RVTISKDTSKNQVSFKMSSVQAADTAVYYCAR | 1C1 | 1171 |
| RVTISKDTSKNQVSFKMSSVTAQDTAVYYCAR | 1C1 | 1172 |
| RVTISKDTSKNQVSFKLSSLQAADTAVYYCAR | 1C1 | 1173 |
| RVTISKDTSKNQVSFKLSSLTAQDTAVYYCAR | 1C1 | 1174 |
| RVTISKDTSKNQVSFKLSSVQAQDTAVYYCAR | 1C1 | 1175 |
| RVTISKDTSKNQVSLKMSSLQAADTAVYYCAR | 1C1 | 1176 |
| RVTISKDTSKNQVSLKMSSLTAQDTAVYYCAR | 1C1 | 1177 |
| RVTISKDTSKNQVSLKMSSVQAQDTAVYYCAR | 1C1 | 1178 |
| RVTISKDTSKNQVSLKLSSLQAQDTAVYYCAR | 1C1 | 1179 |
| RVTISKDTSKNQFSFKMSSLQAADTAVYYCAR | 1C1 | 1180 |
| RVTISKDTSKNQFSFKMSSLTAQDTAVYYCAR | 1C1 | 1181 |
| RVTISKDTSKNQFSFKMSSVQAQDTAVYYCAR | 1C1 | 1182 |
| RVTISKDTSKNQFSFKLSSLQAQDTAVYYCAR | 1C1 | 1183 |
| RVTISKDTSKNQFSLKMSSLQAQDTAVYYCAR | 1C1 | 1184 |
| RVTISVDNSKSQVSFKMSSVTAADTAVYYCAR | 1C1 | 1185 |
| RVTISVDNSKSQVSFKLSSLTAADTAVYYCAR | 1C1 | 1186 |
| RVTISVDNSKSQVSFKLSSVQAADTAVYYCAR | 1C1 | 1187 |
| RVTISVDNSKSQVSFKLSSVTAQDTAVYYCAR | 1C1 | 1188 |
| RVTISVDNSKSQVSLKMSSLTAADTAVYYCAR | 1C1 | 1189 |
| RVTISVDNSKSQVSLKMSSVQAADTAVYYCAR | 1C1 | 1190 |
| RVTISVDNSKSQVSLKMSSVTAQDTAVYYCAR | 1C1 | 1191 |
| RVTISVDNSKSQVSLKLSSLQAADTAVYYCAR | 1C1 | 1192 |
| RVTISVDNSKSQVSLKLSSLTAQDTAVYYCAR | 1C1 | 1193 |
| RVTISVDNSKSQVSLKLSSVQAQDTAVYYCAR | 1C1 | 1194 |
| RVTISVDNSKSQFSFKMSSLTAADTAVYYCAR | 1C1 | 1195 |
| RVTISVDNSKSQFSFKMSSVQAADTAVYYCAR | 1C1 | 1196 |
| RVTISVDNSKSQFSFKMSSVTAQDTAVYYCAR | 1C1 | 1197 |

TABLE 25-continued

Exemplary Framework Sequences for Humanized Anti-GFRAL Antibodies

| | | |
|---|---|---|
| RVTISVDNSKSQFSFKLSSLQAADTAVYYCAR | 1C1 | 1198 |
| RVTISVDNSKSQFSFKLSSLTAQDTAVYYCAR | 1C1 | 1199 |
| RVTISVDNSKSQFSFKLSSVQAQDTAVYYCAR | 1C1 | 1200 |
| RVTISVDNSKSQFSLKMSSLQAADTAVYYCAR | 1C1 | 1201 |
| RVTISVDNSKSQFSLKMSSLTAQDTAVYYCAR | 1C1 | 1202 |
| RVTISVDNSKSQFSLKMSSVQAQDTAVYYCAR | 1C1 | 1203 |
| RVTISVDNSKSQFSLKLSSLQAQDTAVYYCAR | 1C1 | 1204 |
| RVTISVDNSKNQVSFKMSSLTAADTAVYYCAR | 1C1 | 1205 |
| RVTISVDNSKNQVSFKMSSVQAADTAVYYCAR | 1C1 | 1206 |
| RVTISVDNSKNQVSFKMSSVTAQDTAVYYCAR | 1C1 | 1207 |
| RVTISVDNSKNQVSFKLSSLQAADTAVYYCAR | 1C1 | 1208 |
| RVTISVDNSKNQVSFKLSSLTAQDTAVYYCAR | 1C1 | 1209 |
| RVTISVDNSKNQVSFKLSSVQAQDTAVYYCAR | 1C1 | 1210 |
| RVTISVDNSKNQVSLKMSSLQAADTAVYYCAR | 1C1 | 1211 |
| RVTISVDNSKNQVSLKMSSLTAQDTAVYYCAR | 1C1 | 1212 |
| RVTISVDNSKNQVSLKMSSVQAQDTAVYYCAR | 1C1 | 1213 |
| RVTISVDNSKNQVSLKLSSLQAQDTAVYYCAR | 1C1 | 1214 |
| RVTISVDNSKNQFSFKMSSLQAADTAVYYCAR | 1C1 | 1215 |
| RVTISVDNSKNQFSFKMSSLTAQDTAVYYCAR | 1C1 | 1216 |
| RVTISVDNSKNQFSFKMSSVQAQDTAVYYCAR | 1C1 | 1217 |
| RVTISVDNSKNQFSFKLSSLQAQDTAVYYCAR | 1C1 | 1218 |
| RVTISVDNSKNQFSLKMSSLQAQDTAVYYCAR | 1C1 | 1219 |
| RVTISVDTSKSQVSFKMSSLTAADTAVYYCAR | 1C1 | 1220 |
| RVTISVDTSKSQVSFKMSSVQAADTAVYYCAR | 1C1 | 1221 |
| RVTISVDTSKSQVSFKMSSVTAQDTAVYYCAR | 1C1 | 1222 |
| RVTISVDTSKSQVSFKLSSLQAADTAVYYCAR | 1C1 | 1223 |
| RVTISVDTSKSQVSFKLSSLTAQDTAVYYCAR | 1C1 | 1224 |
| RVTISVDTSKSQVSFKLSSVQAQDTAVYYCAR | 1C1 | 1225 |
| RVTISVDTSKSQVSLKMSSLQAADTAVYYCAR | 1C1 | 1226 |
| RVTISVDTSKSQVSLKMSSLTAQDTAVYYCAR | 1C1 | 1227 |
| RVTISVDTSKSQVSLKMSSVQAQDTAVYYCAR | 1C1 | 1228 |
| RVTISVDTSKSQVSLKLSSLQAQDTAVYYCAR | 1C1 | 1229 |
| RVTISVDTSKSQFSFKMSSLQAADTAVYYCAR | 1C1 | 1230 |
| RVTISVDTSKSQFSFKMSSLTAQDTAVYYCAR | 1C1 | 1231 |
| RVTISVDTSKSQFSFKMSSVQAQDTAVYYCAR | 1C1 | 1232 |
| RVTISVDTSKSQFSFKLSSLQAQDTAVYYCAR | 1C1 | 1233 |
| RVTISVDTSKSQFSLKMSSLQAQDTAVYYCAR | 1C1 | 1234 |
| RVTISVDTSKNQVSFKMSSLQAADTAVYYCAR | 1C1 | 1235 |
| RVTISVDTSKNQVSFKMSSLTAQDTAVYYCAR | 1C1 | 1236 |

TABLE 25-continued

Exemplary Framework Sequences for Humanized Anti-GFRAL Antibodies

| | | |
|---|---|---|
| RVTISVDTSKNQVSFKMSSVQAQDTAVYYCAR | 1C1 | 1237 |
| RVTISVDTSKNQVSFKLSSLQAQDTAVYYCAR | 1C1 | 1238 |
| RVTISVDTSKNQVSLKMSSLQAQDTAVYYCAR | 1C1 | 1239 |
| RVTISVDTSKNQFSFKMSSLQAQDTAVYYCAR | 1C1 | 1240 |
| RLTISKDNSKSQVSFKLSSVTAADTAVYYCAR | 1C1 | 1241 |
| RLTISKDNSKSQVSLKMSSVTAADTAVYYCAR | 1C1 | 1242 |
| RLTISKDNSKSQVSLKLSSLTAADTAVYYCAR | 1C1 | 1243 |
| RLTISKDNSKSQVSLKLSSVQAADTAVYYCAR | 1C1 | 1244 |
| RLTISKDNSKSQVSLKLSSVTAQDTAVYYCAR | 1C1 | 1245 |
| RLTISKDNSKSQFSFKMSSVTAADTAVYYCAR | 1C1 | 1246 |
| RLTISKDNSKSQFSFKLSSLTAADTAVYYCAR | 1C1 | 1247 |
| RLTISKDNSKSQFSFKLSSVQAADTAVYYCAR | 1C1 | 1248 |
| RLTISKDNSKSQFSFKLSSVTAQDTAVYYCAR | 1C1 | 1249 |
| RLTISKDNSKSQFSLKMSSLTAADTAVYYCAR | 1C1 | 1250 |
| RLTISKDNSKSQFSLKMSSVQAADTAVYYCAR | 1C1 | 1251 |
| RLTISKDNSKSQFSLKMSSVTAQDTAVYYCAR | 1C1 | 1252 |
| RLTISKDNSKSQFSLKLSSLQAADTAVYYCAR | 1C1 | 1253 |
| RLTISKDNSKSQFSLKLSSLTAQDTAVYYCAR | 1C1 | 1254 |
| RLTISKDNSKSQFSLKLSSVQAQDTAVYYCAR | 1C1 | 1255 |
| RLTISKDNSKNQVSFKMSSVTAADTAVYYCAR | 1C1 | 1256 |
| RLTISKDNSKNQVSFKLSSLTAADTAVYYCAR | 1C1 | 1257 |
| RLTISKDNSKNQVSFKLSSVQAADTAVYYCAR | 1C1 | 1258 |
| RLTISKDNSKNQVSFKLSSVTAQDTAVYYCAR | 1C1 | 1259 |
| RLTISKDNSKNQVSLKMSSLTAADTAVYYCAR | 1C1 | 1260 |
| RLTISKDNSKNQVSLKMSSVQAADTAVYYCAR | 1C1 | 1261 |
| RLTISKDNSKNQVSLKMSSVTAQDTAVYYCAR | 1C1 | 1262 |
| RLTISKDNSKNQVSLKLSSLQAADTAVYYCAR | 1C1 | 1263 |
| RLTISKDNSKNQVSLKLSSLTAQDTAVYYCAR | 1C1 | 1264 |
| RLTISKDNSKNQVSLKLSSVQAQDTAVYYCAR | 1C1 | 1265 |
| RLTISKDNSKNQFSFKMSSLTAADTAVYYCAR | 1C1 | 1266 |
| RLTISKDNSKNQFSFKMSSVQAADTAVYYCAR | 1C1 | 1267 |
| RLTISKDNSKNQFSFKMSSVTAQDTAVYYCAR | 1C1 | 1268 |
| RLTISKDNSKNQFSFKLSSLQAADTAVYYCAR | 1C1 | 1269 |
| RLTISKDNSKNQFSFKLSSLTAQDTAVYYCAR | 1C1 | 1270 |
| RLTISKDNSKNQFSFKLSSVQAQDTAVYYCAR | 1C1 | 1271 |
| RLTISKDNSKNQFSLKMSSLQAADTAVYYCAR | 1C1 | 1272 |
| RLTISKDNSKNQFSLKMSSLTAQDTAVYYCAR | 1C1 | 1273 |
| RLTISKDNSKNQFSLKMSSVQAQDTAVYYCAR | 1C1 | 1274 |
| RLTISKDNSKNQFSLKLSSLQAQDTAVYYCAR | 1C1 | 1275 |

TABLE 25-continued

Exemplary Framework Sequences for Humanized Anti-GFRAL Antibodies

| | | |
|---|---|---|
| RLTISKDTSKSQVSFKMSSVTAADTAVYYCAR | 1C1 | 1276 |
| RLTISKDTSKSQVSFKLSSLTAADTAVYYCAR | 1C1 | 1277 |
| RLTISKDTSKSQVSFKLSSVQAADTAVYYCAR | 1C1 | 1278 |
| RLTISKDTSKSQVSFKLSSVTAQDTAVYYCAR | 1C1 | 1279 |
| RLTISKDTSKSQVSLKMSSLTAADTAVYYCAR | 1C1 | 1280 |
| RLTISKDTSKSQVSLKMSSVQAADTAVYYCAR | 1C1 | 1281 |
| RLTISKDTSKSQVSLKMSSVTAQDTAVYYCAR | 1C1 | 1282 |
| RLTISKDTSKSQVSLKLSSLQAADTAVYYCAR | 1C1 | 1283 |
| RLTISKDTSKSQVSLKLSSLTAQDTAVYYCAR | 1C1 | 1284 |
| RLTISKDTSKSQVSLKLSSVQAQDTAVYYCAR | 1C1 | 1285 |
| RLTISKDTSKSQFSFKMSSLTAADTAVYYCAR | 1C1 | 1286 |
| RLTISKDTSKSQFSFKMSSVQAADTAVYYCAR | 1C1 | 1287 |
| RLTISKDTSKSQFSFKMSSVTAQDTAVYYCAR | 1C1 | 1288 |
| RLTISKDTSKSQFSFKLSSLQAADTAVYYCAR | 1C1 | 1289 |
| RLTISKDTSKSQFSFKLSSLTAQDTAVYYCAR | 1C1 | 1290 |
| RLTISKDTSKSQFSFKLSSVQAQDTAVYYCAR | 1C1 | 1291 |
| RLTISKDTSKSQFSLKMSSLQAADTAVYYCAR | 1C1 | 1292 |
| RLTISKDTSKSQFSLKMSSLTAQDTAVYYCAR | 1C1 | 1293 |
| RLTISKDTSKSQFSLKMSSVQAQDTAVYYCAR | 1C1 | 1294 |
| RLTISKDTSKSQFSLKLSSLQAQDTAVYYCAR | 1C1 | 1295 |
| RLTISKDTSKNQVSFKMSSLTAADTAVYYCAR | 1C1 | 1296 |
| RLTISKDTSKNQVSFKMSSVQAADTAVYYCAR | 1C1 | 1297 |
| RLTISKDTSKNQVSFKMSSVTAQDTAVYYCAR | 1C1 | 1298 |
| RLTISKDTSKNQVSFKLSSLQAADTAVYYCAR | 1C1 | 1299 |
| RLTISKDTSKNQVSFKLSSLTAQDTAVYYCAR | 1C1 | 1300 |
| RLTISKDTSKNQVSFKLSSVQAQDTAVYYCAR | 1C1 | 1301 |
| RLTISKDTSKNQVSLKMSSLQAADTAVYYCAR | 1C1 | 1302 |
| RLTISKDTSKNQVSLKMSSLTAQDTAVYYCAR | 1C1 | 1303 |
| RLTISKDTSKNQVSLKMSSVQAQDTAVYYCAR | 1C1 | 1304 |
| RLTISKDTSKNQVSLKLSSLQAQDTAVYYCAR | 1C1 | 1305 |
| RLTISKDTSKNQFSFKMSSLQAADTAVYYCAR | 1C1 | 1306 |
| RLTISKDTSKNQFSFKMSSLTAQDTAVYYCAR | 1C1 | 1307 |
| RLTISKDTSKNQFSFKMSSVQAQDTAVYYCAR | 1C1 | 1308 |
| RLTISKDTSKNQFSFKLSSLQAQDTAVYYCAR | 1C1 | 1309 |
| RLTISKDTSKNQFSLKMSSLQAQDTAVYYCAR | 1C1 | 1310 |
| RLTISVDNSKSQVSFKMSSVTAADTAVYYCAR | 1C1 | 1311 |
| RLTISVDNSKSQVSFKLSSLTAADTAVYYCAR | 1C1 | 1312 |
| RLTISVDNSKSQVSFKLSSVQAADTAVYYCAR | 1C1 | 1313 |
| RLTISVDNSKSQVSFKLSSVTAQDTAVYYCAR | 1C1 | 1314 |

TABLE 25-continued

Exemplary Framework Sequences for Humanized Anti-GFRAL Antibodies

| | | |
|---|---|---|
| RLTISVDNSKSQVSLKMSSLTAADTAVYYCAR | 1C1 | 1315 |
| RLTISVDNSKSQVSLKMSSVQAADTAVYYCAR | 1C1 | 1316 |
| RLTISVDNSKSQVSLKMSSVTAQDTAVYYCAR | 1C1 | 1317 |
| RLTISVDNSKSQVSLKLSSLQAADTAVYYCAR | 1C1 | 1318 |
| RLTISVDNSKSQVSLKLSSLTAQDTAVYYCAR | 1C1 | 1319 |
| RLTISVDNSKSQVSLKLSSVQAQDTAVYYCAR | 1C1 | 1320 |
| RLTISVDNSKSQFSFKMSSLTAADTAVYYCAR | 1C1 | 1321 |
| RLTISVDNSKSQFSFKMSSVQAADTAVYYCAR | 1C1 | 1322 |
| RLTISVDNSKSQFSFKMSSVTAQDTAVYYCAR | 1C1 | 1323 |
| RLTISVDNSKSQFSFKLSSLQAADTAVYYCAR | 1C1 | 1324 |
| RLTISVDNSKSQFSFKLSSLTAQDTAVYYCAR | 1C1 | 1325 |
| RLTISVDNSKSQFSFKLSSVQAQDTAVYYCAR | 1C1 | 1326 |
| RLTISVDNSKSQFSLKMSSLQAADTAVYYCAR | 1C1 | 1327 |
| RLTISVDNSKSQFSLKMSSLTAQDTAVYYCAR | 1C1 | 1328 |
| RLTISVDNSKSQFSLKMSSVQAQDTAVYYCAR | 1C1 | 1329 |
| RLTISVDNSKSQFSLKLSSLQAQDTAVYYCAR | 1C1 | 1330 |
| RLTISVDNSKNQVSFKMSSLTAADTAVYYCAR | 1C1 | 1331 |
| RLTISVDNSKNQVSFKMSSVQAADTAVYYCAR | 1C1 | 1332 |
| RLTISVDNSKNQVSFKMSSVTAQDTAVYYCAR | 1C1 | 1333 |
| RLTISVDNSKNQVSFKLSSLQAADTAVYYCAR | 1C1 | 1334 |
| RLTISVDNSKNQVSFKLSSLTAQDTAVYYCAR | 1C1 | 1335 |
| RLTISVDNSKNQVSFKLSSVQAQDTAVYYCAR | 1C1 | 1336 |
| RLTISVDNSKNQVSLKMSSLQAADTAVYYCAR | 1C1 | 1337 |
| RLTISVDNSKNQVSLKMSSLTAQDTAVYYCAR | 1C1 | 1338 |
| RLTISVDNSKNQVSLKMSSVQAQDTAVYYCAR | 1C1 | 1339 |
| RLTISVDNSKNQVSLKLSSLQAQDTAVYYCAR | 1C1 | 1340 |
| RLTISVDNSKNQFSFKMSSLQAADTAVYYCAR | 1C1 | 1341 |
| RLTISVDNSKNQFSFKMSSLTAQDTAVYYCAR | 1C1 | 1342 |
| RLTISVDNSKNQFSFKMSSVQAQDTAVYYCAR | 1C1 | 1343 |
| RLTISVDNSKNQFSFKLSSLQAQDTAVYYCAR | 1C1 | 1344 |
| RLTISVDNSKNQFSLKMSSLQAQDTAVYYCAR | 1C1 | 1345 |
| RLTISVDTSKSQVSFKMSSLTAADTAVYYCAR | 1C1 | 1346 |
| RLTISVDTSKSQVSFKMSSVQAADTAVYYCAR | 1C1 | 1347 |
| RLTISVDTSKSQVSFKMSSVTAQDTAVYYCAR | 1C1 | 1348 |
| RLTISVDTSKSQVSFKLSSLQAADTAVYYCAR | 1C1 | 1349 |
| RLTISVDTSKSQVSFKLSSLTAQDTAVYYCAR | 1C1 | 1350 |
| RLTISVDTSKSQVSFKLSSVQAQDTAVYYCAR | 1C1 | 1351 |
| RLTISVDTSKSQVSLKMSSLQAADTAVYYCAR | 1C1 | 1352 |
| RLTISVDTSKSQVSLKMSSLTAQDTAVYYCAR | 1C1 | 1353 |

TABLE 25-continued

Exemplary Framework Sequences for Humanized Anti-GFRAL Antibodies

| | | |
|---|---|---|
| RLTISVDTSKSQVSLKMSSVQAQDTAVYYCAR | 1C1 | 1354 |
| RLTISVDTSKSQVSLKLSSLQAQDTAVYYCAR | 1C1 | 1355 |
| RLTISVDTSKSQFSFKMSSLQAADTAVYYCAR | 1C1 | 1356 |
| RLTISVDTSKSQFSFKMSSLTAQDTAVYYCAR | 1C1 | 1357 |
| RLTISVDTSKSQFSFKMSSVQAQDTAVYYCAR | 1C1 | 1358 |
| RLTISVDTSKSQFSFKLSSLQAQDTAVYYCAR | 1C1 | 1359 |
| RLTISVDTSKSQFSLKMSSLQAQDTAVYYCAR | 1C1 | 1360 |
| RLTISVDTSKNQVSFKMSSLQAADTAVYYCAR | 1C1 | 1361 |
| RLTISVDTSKNQVSFKMSSLTAQDTAVYYCAR | 1C1 | 1362 |
| RLTISVDTSKNQVSFKMSSVQAQDTAVYYCAR | 1C1 | 1363 |
| RLTISVDTSKNQVSFKLSSLQAQDTAVYYCAR | 1C1 | 1364 |
| RLTISVDTSKNQVSLKMSSLQAQDTAVYYCAR | 1C1 | 1365 |
| RLTISVDTSKNQFSFKMSSLQAQDTAVYYCAR | 1C1 | 1366 |
| RVTISKDNSKSQVSFKMSSVTAADTAVYYCAR | 1C1 | 1367 |
| RVTISKDNSKSQVSFKLSSLTAADTAVYYCAR | 1C1 | 1368 |
| RVTISKDNSKSQVSFKLSSVQAADTAVYYCAR | 1C1 | 1369 |
| RVTISKDNSKSQVSFKLSSVTAQDTAVYYCAR | 1C1 | 1370 |
| RVTISKDNSKSQVSLKMSSLTAADTAVYYCAR | 1C1 | 1371 |
| RVTISKDNSKSQVSLKMSSVQAADTAVYYCAR | 1C1 | 1372 |
| RVTISKDNSKSQVSLKMSSVTAQDTAVYYCAR | 1C1 | 1373 |
| RVTISKDNSKSQVSLKLSSLQAADTAVYYCAR | 1C1 | 1374 |
| RVTISKDNSKSQVSLKLSSLTAQDTAVYYCAR | 1C1 | 1375 |
| RVTISKDNSKSQVSLKLSSVQAQDTAVYYCAR | 1C1 | 1376 |
| RVTISKDNSKSQFSFKMSSLTAADTAVYYCAR | 1C1 | 1377 |
| RVTISKDNSKSQFSFKMSSVQAADTAVYYCAR | 1C1 | 1378 |
| RVTISKDNSKSQFSFKMSSVTAQDTAVYYCAR | 1C1 | 1379 |
| RVTISKDNSKSQFSFKLSSLQAADTAVYYCAR | 1C1 | 1380 |
| RVTISKDNSKSQFSFKLSSLTAQDTAVYYCAR | 1C1 | 1381 |
| RVTISKDNSKSQFSFKLSSVQAQDTAVYYCAR | 1C1 | 1382 |
| RVTISKDNSKSQFSLKMSSLQAADTAVYYCAR | 1C1 | 1383 |
| RVTISKDNSKSQFSLKMSSLTAQDTAVYYCAR | 1C1 | 1384 |
| RVTISKDNSKSQFSLKMSSVQAQDTAVYYCAR | 1C1 | 1385 |
| RVTISKDNSKSQFSLKLSSLQAQDTAVYYCAR | 1C1 | 1386 |
| RVTISKDNSKNQVSFKMSSLTAADTAVYYCAR | 1C1 | 1387 |
| RVTISKDNSKNQVSFKMSSVQAADTAVYYCAR | 1C1 | 1388 |
| RVTISKDNSKNQVSFKMSSVTAQDTAVYYCAR | 1C1 | 1389 |
| RVTISKDNSKNQVSFKLSSLQAADTAVYYCAR | 1C1 | 1390 |
| RVTISKDNSKNQVSFKLSSLTAQDTAVYYCAR | 1C1 | 1391 |
| RVTISKDNSKNQVSFKLSSVQAQDTAVYYCAR | 1C1 | 1392 |

TABLE 25-continued

Exemplary Framework Sequences for Humanized Anti-GFRAL Antibodies

| | | |
|---|---|---|
| RVTISKDNSKNQVSLKMSSLQAADTAVYYCAR | 1C1 | 1393 |
| RVTISKDNSKNQVSLKMSSLTAQDTAVYYCAR | 1C1 | 1394 |
| RVTISKDNSKNQVSLKMSSVQAQDTAVYYCAR | 1C1 | 1395 |
| RVTISKDNSKNQVSLKLSSLQAQDTAVYYCAR | 1C1 | 1396 |
| RVTISKDNSKNQFSFKMSSLQAADTAVYYCAR | 1C1 | 1397 |
| RVTISKDNSKNQFSFKMSSLTAQDTAVYYCAR | 1C1 | 1398 |
| RVTISKDNSKNQFSFKMSSVQAQDTAVYYCAR | 1C1 | 1399 |
| RVTISKDNSKNQFSFKLSSLQAQDTAVYYCAR | 1C1 | 1400 |
| RVTISKDNSKNQFSLKMSSLQAQDTAVYYCAR | 1C1 | 1401 |
| RVTISKDTSKSQVSFKMSSLTAADTAVYYCAR | 1C1 | 1402 |
| RVTISKDTSKSQVSFKMSSVQAADTAVYYCAR | 1C1 | 1403 |
| RVTISKDTSKSQVSFKMSSVTAQDTAVYYCAR | 1C1 | 1404 |
| RVTISKDTSKSQVSFKLSSLQAADTAVYYCAR | 1C1 | 1405 |
| RVTISKDTSKSQVSFKLSSLTAQDTAVYYCAR | 1C1 | 1406 |
| RVTISKDTSKSQVSFKLSSVQAQDTAVYYCAR | 1C1 | 1407 |
| RVTISKDTSKSQVSLKMSSLQAADTAVYYCAR | 1C1 | 1408 |
| RVTISKDTSKSQVSLKMSSLTAQDTAVYYCAR | 1C1 | 1409 |
| RVTISKDTSKSQVSLKMSSVQAQDTAVYYCAR | 1C1 | 1410 |
| RVTISKDTSKSQVSLKLSSLQAQDTAVYYCAR | 1C1 | 1411 |
| RVTISKDTSKSQFSFKMSSLQAADTAVYYCAR | 1C1 | 1412 |
| RVTISKDTSKSQFSFKMSSLTAQDTAVYYCAR | 1C1 | 1413 |
| RVTISKDTSKSQFSFKMSSVQAQDTAVYYCAR | 1C1 | 1414 |
| RVTISKDTSKSQFSFKLSSLQAQDTAVYYCAR | 1C1 | 1415 |
| RVTISKDTSKSQFSLKMSSLQAQDTAVYYCAR | 1C1 | 1416 |
| RVTISKDTSKNQVSFKMSSLQAADTAVYYCAR | 1C1 | 1417 |
| RVTISKDTSKNQVSFKMSSLTAQDTAVYYCAR | 1C1 | 1418 |
| RVTISKDTSKNQVSFKMSSVQAQDTAVYYCAR | 1C1 | 1419 |
| RVTISKDTSKNQVSFKLSSLQAQDTAVYYCAR | 1C1 | 1420 |
| RVTISKDTSKNQVSLKMSSLQAQDTAVYYCAR | 1C1 | 1421 |
| RVTISKDTSKNQFSFKMSSLQAQDTAVYYCAR | 1C1 | 1422 |
| RVTISVDNSKSQVSFKMSSLTAADTAVYYCAR | 1C1 | 1423 |
| RVTISVDNSKSQVSFKMSSVQAADTAVYYCAR | 1C1 | 1424 |
| RVTISVDNSKSQVSFKMSSVTAQDTAVYYCAR | 1C1 | 1425 |
| RVTISVDNSKSQVSFKLSSLQAADTAVYYCAR | 1C1 | 1426 |
| RVTISVDNSKSQVSFKLSSLTAQDTAVYYCAR | 1C1 | 1427 |
| RVTISVDNSKSQVSFKLSSVQAQDTAVYYCAR | 1C1 | 1428 |
| RVTISVDNSKSQVSLKMSSLQAADTAVYYCAR | 1C1 | 1429 |
| RVTISVDNSKSQVSLKMSSLTAQDTAVYYCAR | 1C1 | 1430 |
| RVTISVDNSKSQVSLKMSSVQAQDTAVYYCAR | 1C1 | 1431 |

TABLE 25-continued

Exemplary Framework Sequences for Humanized Anti-GFRAL Antibodies

| | | |
|---|---|---|
| RVTISVDNSKSQVSLKLSSLQAQDTAVYYCAR | 1C1 | 1432 |
| RVTISVDNSKSQFSFKMSSLQAADTAVYYCAR | 1C1 | 1433 |
| RVTISVDNSKSQFSFKMSSLTAQDTAVYYCAR | 1C1 | 1434 |
| RVTISVDNSKSQFSFKMSSVQAQDTAVYYCAR | 1C1 | 1435 |
| RVTISVDNSKSQFSFKLSSLQAQDTAVYYCAR | 1C1 | 1436 |
| RVTISVDNSKSQFSLKMSSLQAQDTAVYYCAR | 1C1 | 1437 |
| RVTISVDNSKNQVSFKMSSLQAADTAVYYCAR | 1C1 | 1438 |
| RVTISVDNSKNQVSFKMSSLTAQDTAVYYCAR | 1C1 | 1439 |
| RVTISVDNSKNQVSFKMSSVQAQDTAVYYCAR | 1C1 | 1440 |
| RVTISVDNSKNQVSFKLSSLQAQDTAVYYCAR | 1C1 | 1441 |
| RVTISVDNSKNQVSLKMSSLQAQDTAVYYCAR | 1C1 | 1442 |
| RVTISVDNSKNQFSFKMSSLQAQDTAVYYCAR | 1C1 | 1443 |
| RVTISVDTSKSQVSFKMSSLQAADTAVYYCAR | 1C1 | 1444 |
| RVTISVDTSKSQVSFKMSSLTAQDTAVYYCAR | 1C1 | 1445 |
| RVTISVDTSKSQVSFKMSSVQAQDTAVYYCAR | 1C1 | 1446 |
| RVTISVDTSKSQVSFKLSSLQAQDTAVYYCAR | 1C1 | 1447 |
| RVTISVDTSKSQVSLKMSSLQAQDTAVYYCAR | 1C1 | 1448 |
| RVTISVDTSKSQFSFKMSSLQAQDTAVYYCAR | 1C1 | 1449 |
| RVTISVDTSKNQVSFKMSSLQAQDTAVYYCAR | 1C1 | 1450 |
| RLTISKDNSKSQVSFKMSSVTAADTAVYYCAR | 1C1 | 1451 |
| RLTISKDNSKSQVSFKLSSLTAADTAVYYCAR | 1C1 | 1452 |
| RLTISKDNSKSQVSFKLSSVQAADTAVYYCAR | 1C1 | 1453 |
| RLTISKDNSKSQVSFKLSSVTAQDTAVYYCAR | 1C1 | 1454 |
| RLTISKDNSKSQVSLKMSSLTAADTAVYYCAR | 1C1 | 1455 |
| RLTISKDNSKSQVSLKMSSVQAADTAVYYCAR | 1C1 | 1456 |
| RLTISKDNSKSQVSLKMSSVTAQDTAVYYCAR | 1C1 | 1457 |
| RLTISKDNSKSQVSLKLSSLQAADTAVYYCAR | 1C1 | 1458 |
| RLTISKDNSKSQVSLKLSSLTAQDTAVYYCAR | 1C1 | 1459 |
| RLTISKDNSKSQVSLKLSSVQAQDTAVYYCAR | 1C1 | 1460 |
| RLTISKDNSKSQFSFKMSSLTAADTAVYYCAR | 1C1 | 1461 |
| RLTISKDNSKSQFSFKMSSVQAADTAVYYCAR | 1C1 | 1462 |
| RLTISKDNSKSQFSFKMSSVTAQDTAVYYCAR | 1C1 | 1463 |
| RLTISKDNSKSQFSFKLSSLQAADTAVYYCAR | 1C1 | 1464 |
| RLTISKDNSKSQFSFKLSSLTAQDTAVYYCAR | 1C1 | 1465 |
| RLTISKDNSKSQFSFKLSSVQAQDTAVYYCAR | 1C1 | 1466 |
| RLTISKDNSKSQFSLKMSSLQAADTAVYYCAR | 1C1 | 1467 |
| RLTISKDNSKSQFSLKMSSLTAQDTAVYYCAR | 1C1 | 1468 |
| RLTISKDNSKSQFSLKMSSVQAQDTAVYYCAR | 1C1 | 1469 |
| RLTISKDNSKSQFSLKLSSLQAQDTAVYYCAR | 1C1 | 1470 |

TABLE 25-continued

Exemplary Framework Sequences for Humanized Anti-GFRAL Antibodies

| | | |
|---|---|---|
| RLTISKDNSKNQVSFKMSSLTAADTAVYYCAR | 1C1 | 1471 |
| RLTISKDNSKNQVSFKMSSVQAADTAVYYCAR | 1C1 | 1472 |
| RLTISKDNSKNQVSFKMSSVTAQDTAVYYCAR | 1C1 | 1473 |
| RLTISKDNSKNQVSFKLSSLQAADTAVYYCAR | 1C1 | 1474 |
| RLTISKDNSKNQVSFKLSSLTAQDTAVYYCAR | 1C1 | 1475 |
| RLTISKDNSKNQVSFKLSSVQAQDTAVYYCAR | 1C1 | 1476 |
| RLTISKDNSKNQVSLKMSSLQAADTAVYYCAR | 1C1 | 1477 |
| RLTISKDNSKNQVSLKMSSLTAQDTAVYYCAR | 1C1 | 1478 |
| RLTISKDNSKNQVSLKMSSVQAQDTAVYYCAR | 1C1 | 1479 |
| RLTISKDNSKNQVSLKLSSLQAQDTAVYYCAR | 1C1 | 1480 |
| RLTISKDNSKNQFSFKMSSLQAADTAVYYCAR | 1C1 | 1481 |
| RLTISKDNSKNQFSFKMSSLTAQDTAVYYCAR | 1C1 | 1482 |
| RLTISKDNSKNQFSFKMSSVQAQDTAVYYCAR | 1C1 | 1483 |
| RLTISKDNSKNQFSFKLSSLQAQDTAVYYCAR | 1C1 | 1484 |
| RLTISKDNSKNQFSLKMSSLQAQDTAVYYCAR | 1C1 | 1485 |
| RLTISKDTSKSQVSFKMSSLTAADTAVYYCAR | 1C1 | 1486 |
| RLTISKDTSKSQVSFKMSSVQAADTAVYYCAR | 1C1 | 1487 |
| RLTISKDTSKSQVSFKMSSVTAQDTAVYYCAR | 1C1 | 1488 |
| RLTISKDTSKSQVSFKLSSLQAADTAVYYCAR | 1C1 | 1489 |
| RLTISKDTSKSQVSFKLSSLTAQDTAVYYCAR | 1C1 | 1490 |
| RLTISKDTSKSQVSFKLSSVQAQDTAVYYCAR | 1C1 | 1491 |
| RLTISKDTSKSQVSLKMSSLQAADTAVYYCAR | 1C1 | 1492 |
| RLTISKDTSKSQVSLKMSSLTAQDTAVYYCAR | 1C1 | 1493 |
| RLTISKDTSKSQVSLKMSSVQAQDTAVYYCAR | 1C1 | 1494 |
| RLTISKDTSKSQVSLKLSSLQAQDTAVYYCAR | 1C1 | 1495 |
| RLTISKDTSKSQFSFKMSSLQAADTAVYYCAR | 1C1 | 1496 |
| RLTISKDTSKSQFSFKMSSLTAQDTAVYYCAR | 1C1 | 1497 |
| RLTISKDTSKSQFSFKMSSVQAQDTAVYYCAR | 1C1 | 1498 |
| RLTISKDTSKSQFSFKLSSLQAQDTAVYYCAR | 1C1 | 1499 |
| RLTISKDTSKSQFSLKMSSLQAQDTAVYYCAR | 1C1 | 1500 |
| RLTISKDTSKNQVSFKMSSLQAADTAVYYCAR | 1C1 | 1501 |
| RLTISKDTSKNQVSFKMSSLTAQDTAVYYCAR | 1C1 | 1502 |
| RLTISKDTSKNQVSFKMSSVQAQDTAVYYCAR | 1C1 | 1503 |
| RLTISKDTSKNQVSFKLSSLQAQDTAVYYCAR | 1C1 | 1504 |
| RLTISKDTSKNQVSLKMSSLQAQDTAVYYCAR | 1C1 | 1505 |
| RLTISKDTSKNQFSFKMSSLQAQDTAVYYCAR | 1C1 | 1506 |
| RLTISVDNSKSQVSFKMSSLTAADTAVYYCAR | 1C1 | 1507 |
| RLTISVDNSKSQVSFKMSSVQAADTAVYYCAR | 1C1 | 1508 |
| RLTISVDNSKSQVSFKMSSVTAQDTAVYYCAR | 1C1 | 1509 |

TABLE 25-continued

Exemplary Framework Sequences for Humanized Anti-GFRAL Antibodies

| | | |
|---|---|---|
| RLTISVDNSKSQVSFKLSSLQAADTAVYYCAR | 1C1 | 1510 |
| RLTISVDNSKSQVSFKLSSLTAQDTAVYYCAR | 1C1 | 1511 |
| RLTISVDNSKSQVSFKLSSVQAQDTAVYYCAR | 1C1 | 1512 |
| RLTISVDNSKSQVSLKMSSLQAADTAVYYCAR | 1C1 | 1513 |
| RLTISVDNSKSQVSLKMSSLTAQDTAVYYCAR | 1C1 | 1514 |
| RLTISVDNSKSQVSLKMSSVQAQDTAVYYCAR | 1C1 | 1515 |
| RLTISVDNSKSQVSLKLSSLQAQDTAVYYCAR | 1C1 | 1516 |
| RLTISVDNSKSQFSFKMSSLQAADTAVYYCAR | 1C1 | 1517 |
| RLTISVDNSKSQFSFKMSSLTAQDTAVYYCAR | 1C1 | 1518 |
| RLTISVDNSKSQFSFKMSSVQAQDTAVYYCAR | 1C1 | 1519 |
| RLTISVDNSKSQFSFKLSSLQAQDTAVYYCAR | 1C1 | 1520 |
| RLTISVDNSKSQFSLKMSSLQAQDTAVYYCAR | 1C1 | 1521 |
| RLTISVDNSKNQVSFKMSSLQAADTAVYYCAR | 1C1 | 1522 |
| RLTISVDNSKNQVSFKMSSLTAQDTAVYYCAR | 1C1 | 1523 |
| RLTISVDNSKNQVSFKMSSVQAQDTAVYYCAR | 1C1 | 1524 |
| RLTISVDNSKNQVSFKLSSLQAQDTAVYYCAR | 1C1 | 1525 |
| RLTISVDNSKNQVSLKMSSLQAQDTAVYYCAR | 1C1 | 1526 |
| RLTISVDNSKNQFSFKMSSLQAQDTAVYYCAR | 1C1 | 1527 |
| RLTISVDTSKSQVSFKMSSLQAADTAVYYCAR | 1C1 | 1528 |
| RLTISVDTSKSQVSFKMSSLTAQDTAVYYCAR | 1C1 | 1529 |
| RLTISVDTSKSQVSFKMSSVQAQDTAVYYCAR | 1C1 | 1530 |
| RLTISVDTSKSQVSFKLSSLQAQDTAVYYCAR | 1C1 | 1531 |
| RLTISVDTSKSQVSLKMSSLQAQDTAVYYCAR | 1C1 | 1532 |
| RLTISVDTSKSQFSFKMSSLQAQDTAVYYCAR | 1C1 | 1533 |
| RLTISVDTSKNQVSFKMSSLQAQDTAVYYCAR | 1C1 | 1534 |
| RVTISKDNSKSQVSFKMSSLTAADTAVYYCAR | 1C1 | 1535 |
| RVTISKDNSKSQVSFKMSSVQAADTAVYYCAR | 1C1 | 1536 |
| RVTISKDNSKSQVSFKMSSVTAQDTAVYYCAR | 1C1 | 1537 |
| RVTISKDNSKSQVSFKLSSLQAADTAVYYCAR | 1C1 | 1538 |
| RVTISKDNSKSQVSFKLSSLTAQDTAVYYCAR | 1C1 | 1539 |
| RVTISKDNSKSQVSFKLSSVQAQDTAVYYCAR | 1C1 | 1540 |
| RVTISKDNSKSQVSLKMSSLQAADTAVYYCAR | 1C1 | 1541 |
| RVTISKDNSKSQVSLKMSSLTAQDTAVYYCAR | 1C1 | 1542 |
| RVTISKDNSKSQVSLKMSSVQAQDTAVYYCAR | 1C1 | 1543 |
| RVTISKDNSKSQVSLKLSSLQAQDTAVYYCAR | 1C1 | 1544 |
| RVTISKDNSKSQFSFKMSSLQAADTAVYYCAR | 1C1 | 1545 |
| RVTISKDNSKSQFSFKMSSLTAQDTAVYYCAR | 1C1 | 1546 |
| RVTISKDNSKSQFSFKMSSVQAQDTAVYYCAR | 1C1 | 1547 |
| RVTISKDNSKSQFSFKLSSLQAQDTAVYYCAR | 1C1 | 1548 |

TABLE 25-continued

Exemplary Framework Sequences for Humanized Anti-GFRAL Antibodies

| Sequence | Clone | SEQ ID |
|---|---|---|
| RVTISKDNSKSQFSLKMSSLQAQDTAVYYCAR | 1C1 | 1549 |
| RVTISKDNSKNQVSFKMSSLQAADTAVYYCAR | 1C1 | 1550 |
| RVTISKDNSKNQVSFKMSSLTAQDTAVYYCAR | 1C1 | 1551 |
| RVTISKDNSKNQVSFKMSSVQAQDTAVYYCAR | 1C1 | 1552 |
| RVTISKDNSKNQVSFKLSSLQAQDTAVYYCAR | 1C1 | 1553 |
| RVTISKDNSKNQVSLKMSSLQAQDTAVYYCAR | 1C1 | 1554 |
| RVTISKDNSKNQFSFKMSSLQAQDTAVYYCAR | 1C1 | 1555 |
| RVTISKDTSKSQVSFKMSSLQAADTAVYYCAR | 1C1 | 1556 |
| RVTISKDTSKSQVSFKMSSLTAQDTAVYYCAR | 1C1 | 1557 |
| RVTISKDTSKSQVSFKMSSVQAQDTAVYYCAR | 1C1 | 1558 |
| RVTISKDTSKSQVSFKLSSLQAQDTAVYYCAR | 1C1 | 1559 |
| RVTISKDTSKSQVSLKMSSLQAQDTAVYYCAR | 1C1 | 1560 |
| RVTISKDTSKSQFSFKMSSLQAQDTAVYYCAR | 1C1 | 1561 |
| RVTISKDTSKNQVSFKMSSLQAQDTAVYYCAR | 1C1 | 1562 |
| RVTISVDNSKSQVSFKMSSLQAADTAVYYCAR | 1C1 | 1563 |
| RVTISVDNSKSQVSFKMSSLTAQDTAVYYCAR | 1C1 | 1564 |
| RVTISVDNSKSQVSFKMSSVQAQDTAVYYCAR | 1C1 | 1565 |
| RVTISVDNSKSQVSFKLSSLQAQDTAVYYCAR | 1C1 | 1566 |
| RVTISVDNSKSQVSLKMSSLQAQDTAVYYCAR | 1C1 | 1567 |
| RVTISVDNSKSQFSFKMSSLQAQDTAVYYCAR | 1C1 | 1568 |
| RVTISVDNSKNQVSFKMSSLQAQDTAVYYCAR | 1C1 | 1569 |
| RVTISVDTSKSQVSFKMSSLQAQDTAVYYCAR | 1C1 | 1570 |
| RLTISKDNSKSQVSFKMSSLTAADTAVYYCAR | 1C1 | 1571 |
| RLTISKDNSKSQVSFKMSSVQAADTAVYYCAR | 1C1 | 1572 |
| RLTISKDNSKSQVSFKMSSVTAQDTAVYYCAR | 1C1 | 1573 |
| RLTISKDNSKSQVSFKLSSLQAADTAVYYCAR | 1C1 | 1574 |
| RLTISKDNSKSQVSFKLSSLTAQDTAVYYCAR | 1C1 | 1575 |
| RLTISKDNSKSQVSFKLSSVQAQDTAVYYCAR | 1C1 | 1576 |
| RLTISKDNSKSQVSLKMSSLQAADTAVYYCAR | 1C1 | 1577 |
| RLTISKDNSKSQVSLKMSSLTAQDTAVYYCAR | 1C1 | 1578 |
| RLTISKDNSKSQVSLKMSSVQAQDTAVYYCAR | 1C1 | 1579 |
| RLTISKDNSKSQVSLKLSSLQAQDTAVYYCAR | 1C1 | 1580 |
| RLTISKDNSKSQFSFKMSSLQAADTAVYYCAR | 1C1 | 1581 |
| RLTISKDNSKSQFSFKMSSLTAQDTAVYYCAR | 1C1 | 1582 |
| RLTISKDNSKSQFSFKMSSVQAQDTAVYYCAR | 1C1 | 1583 |
| RLTISKDNSKSQFSFKLSSLQAQDTAVYYCAR | 1C1 | 1584 |
| RLTISKDNSKSQFSLKMSSLQAQDTAVYYCAR | 1C1 | 1585 |
| RLTISKDNSKNQVSFKMSSLQAADTAVYYCAR | 1C1 | 1586 |
| RLTISKDNSKNQVSFKMSSLTAQDTAVYYCAR | 1C1 | 1587 |

TABLE 25-continued

Exemplary Framework Sequences for Humanized Anti-GFRAL Antibodies

| Sequence | Clone | SEQ ID NO |
|---|---|---|
| RLTISKDNSKNQVSFKMSSVQAQDTAVYYCAR | 1C1 | 1588 |
| RLTISKDNSKNQVSFKLSSLQAQDTAVYYCAR | 1C1 | 1589 |
| RLTISKDNSKNQVSLKMSSLQAQDTAVYYCAR | 1C1 | 1590 |
| RLTISKDNSKNQFSFKMSSLQAQDTAVYYCAR | 1C1 | 1591 |
| RLTISKDTSKSQVSFKMSSLQAADTAVYYCAR | 1C1 | 1592 |
| RLTISKDTSKSQVSFKMSSLTAQDTAVYYCAR | 1C1 | 1593 |
| RLTISKDTSKSQVSFKMSSVQAQDTAVYYCAR | 1C1 | 1594 |
| RLTISKDTSKSQVSFKLSSLQAQDTAVYYCAR | 1C1 | 1595 |
| RLTISKDTSKSQVSLKMSSLQAQDTAVYYCAR | 1C1 | 1596 |
| RLTISKDTSKSQFSFKMSSLQAQDTAVYYCAR | 1C1 | 1597 |
| RLTISKDTSKNQVSFKMSSLQAQDTAVYYCAR | 1C1 | 1598 |
| RLTISVDNSKSQVSFKMSSLQAADTAVYYCAR | 1C1 | 1599 |
| RLTISVDNSKSQVSFKMSSLTAQDTAVYYCAR | 1C1 | 1600 |
| RLTISVDNSKSQVSFKMSSVQAQDTAVYYCAR | 1C1 | 1601 |
| RLTISVDNSKSQVSFKLSSLQAQDTAVYYCAR | 1C1 | 1602 |
| RLTISVDNSKSQVSLKMSSLQAQDTAVYYCAR | 1C1 | 1603 |
| RLTISVDNSKSQFSFKMSSLQAQDTAVYYCAR | 1C1 | 1604 |
| RLTISVDNSKNQVSFKMSSLQAQDTAVYYCAR | 1C1 | 1605 |
| RLTISVDTSKSQVSFKMSSLQAQDTAVYYCAR | 1C1 | 1606 |
| RVTISKDNSKSQVSFKMSSLQAADTAVYYCAR | 1C1 | 1607 |
| RVTISKDNSKSQVSFKMSSLTAQDTAVYYCAR | 1C1 | 1608 |
| RVTISKDNSKSQVSFKMSSVQAQDTAVYYCAR | 1C1 | 1609 |
| RVTISKDNSKSQVSFKLSSLQAQDTAVYYCAR | 1C1 | 1610 |
| RVTISKDNSKSQVSLKMSSLQAQDTAVYYCAR | 1C1 | 1611 |
| RVTISKDNSKSQFSFKMSSLQAQDTAVYYCAR | 1C1 | 1612 |
| RVTISKDNSKNQVSFKMSSLQAQDTAVYYCAR | 1C1 | 1613 |
| RVTISKDTSKSQVSFKMSSLQAQDTAVYYCAR | 1C1 | 1614 |
| RVTISVDNSKSQVSFKMSSLQAQDTAVYYCAR | 1C1 | 1615 |
| RLTISKDNSKSQVSFKMSSLQAADTAVYYCAR | 1C1 | 1616 |
| RLTISKDNSKSQVSFKMSSLTAQDTAVYYCAR | 1C1 | 1617 |
| RLTISKDNSKSQVSFKMSSVQAQDTAVYYCAR | 1C1 | 1618 |
| RLTISKDNSKSQVSFKLSSLQAQDTAVYYCAR | 1C1 | 1619 |
| RLTISKDNSKSQVSLKMSSLQAQDTAVYYCAR | 1C1 | 1620 |
| RLTISKDNSKSQFSFKMSSLQAQDTAVYYCAR | 1C1 | 1621 |
| RLTISKDNSKNQVSFKMSSLQAQDTAVYYCAR | 1C1 | 1622 |
| RLTISKDTSKSQVSFKMSSLQAQDTAVYYCAR | 1C1 | 1623 |
| RLTISVDNSKSQVSFKMSSLQAQDTAVYYCAR | 1C1 | 1624 |
| RVTISKDNSKSQVSFKMSSLQAQDTAVYYCAR | 1C1 | 1625 |
| RLTISKDNSKSQVSFKMSSLQAQDTAVYYCAR | 1C1 | 1626 |

TABLE 25-continued

Exemplary Framework Sequences for Humanized Anti-GFRAL Antibodies

| Sequence | Antibody | SEQ ID |
|---|---|---|
| RVTISRDTSKNQFSLKLSSVTAADTAVYYCAR | 1C1 | 1627 |
| RLTISRDTSKNQFSLKLSSVTAADTAVYYCAR | 1C1 | 1628 |
| RVTISRDTSKSQFSLKLSSVTAADTAVYYCAR | 1C1 | 1629 |
| RVTISRDTSKNQVSLKLSSVTAADTAVYYCAR | 1C1 | 1630 |
| RVTISRDTSKNQFSFKLSSVTAADTAVYYCAR | 1C1 | 1631 |
| RLTISRDTSKSQFSLKLSSVTAADTAVYYCAR | 1C1 | 1632 |
| RLTISRDTSKNQVSLKLSSVTAADTAVYYCAR | 1C1 | 1633 |
| RLTISRDTSKNQFSFKLSSVTAADTAVYYCAR | 1C1 | 1634 |
| RVTISRDTSKSQVSLKLSSVTAADTAVYYCAR | 1C1 | 1635 |
| RVTISRDTSKSQFSFKLSSVTAADTAVYYCAR | 1C1 | 1636 |
| RVTISRDTSKNQVSFKLSSVTAADTAVYYCAR | 1C1 | 1637 |
| RLTISRDTSKSQVSLKLSSVTAADTAVYYCAR | 1C1 | 1638 |
| RLTISRDTSKSQFSFKLSSVTAADTAVYYCAR | 1C1 | 1639 |
| RLTISRDTSKNQVSFKLSSVTAADTAVYYCAR | 1C1 | 1640 |
| RVTISRDTSKSQVSFKLSSVTAADTAVYYCAR | 1C1 | 1641 |
| RLTISRDTSKSQVSFKLSSVTAADTAVYYCAR | 1C1 | 1642 |
| RVTITADESTSTAYMELSSLRSEDTAVYYCAR | 3P10, 5F12, 25M22, 17J16 | 1643 |
| RFTITADESTSTAYMELSSLRSEDTAVYYCAR | 3P10 | 1644 |
| RVTFTADESTSTAYMELSSLRSEDTAVYYCAR | 3P10 | 1645 |
| RVTITLDESTSTAYMELSSLRSEDTAVYYCAR | 3P10 | 1646 |
| RVTITADESTSTAYMELSNLRSEDTAVYYCAR | 3P10 | 1647 |
| RVTITADESTSTAYMELSSLRSEDTAVFYCAR | 3P10 | 1648 |
| RFTFTADESTSTAYMELSSLRSEDTAVYYCAR | 3P10 | 1649 |
| RFTITLDESTSTAYMELSSLRSEDTAVYYCAR | 3P10 | 1650 |
| RFTITADESTSTAYMELSNLRSEDTAVYYCAR | 3P10 | 1651 |
| RFTITADESTSTAYMELSSLRSEDTAVFYCAR | 3P10 | 1652 |
| RVTFTLDESTSTAYMELSSLRSEDTAVYYCAR | 3P10 | 1653 |
| RVTFTADESTSTAYMELSNLRSEDTAVYYCAR | 3P10 | 1654 |
| RVTFTADESTSTAYMELSSLRSEDTAVFYCAR | 3P10 | 1655 |
| RVTITLDESTSTAYMELSNLRSEDTAVYYCAR | 3P10 | 1656 |
| RVTITLDESTSTAYMELSSLRSEDTAVFYCAR | 3P10 | 1657 |
| RVTITADESTSTAYMELSNLRSEDTAVFYCAR | 3P10 | 1658 |
| RFTFTLDESTSTAYMELSSLRSEDTAVYYCAR | 3P10 | 1659 |
| RFTFTADESTSTAYMELSNLRSEDTAVYYCAR | 3P10 | 1660 |
| RFTFTADESTSTAYMELSSLRSEDTAVFYCAR | 3P10 | 1661 |
| RVTFTLDESTSTAYMELSNLRSEDTAVYYCAR | 3P10 | 1662 |
| RVTFTLDESTSTAYMELSSLRSEDTAVFYCAR | 3P10 | 1663 |
| RVTFTADESTSTAYMELSNLRSEDTAVFYCAR | 3P10 | 1664 |

TABLE 25-continued

Exemplary Framework Sequences for Humanized Anti-GFRAL Antibodies

| | | |
|---|---|---|
| RVTITLDESTSTAYMELSNLRSEDTAVFYCAR | 3P10 | 1665 |
| RFTFTLDESTSTAYMELSNLRSEDTAVYYCAR | 3P10 | 1666 |
| RFTFTLDESTSTAYMELSSLRSEDTAVFYCAR | 3P10 | 1667 |
| RFTFTADESTSTAYMELSNLRSEDTAVFYCAR | 3P10 | 1668 |
| RVTFTLDESTSTAYMELSNLRSEDTAVFYCAR | 3P10 | 1669 |
| RFTFTLDESTSTAYMELSNLRSEDTAVFYCAR | 3P10 | 1670 |
| RVTLTADTSTDTAYMELSSLRSEDTAVYFCAR | 3P10 | 1671 |
| RFTLTADTSTDTAYMELSSLRSEDTAVYFCAR | 3P10 | 1672 |
| RVTFTADTSTDTAYMELSSLRSEDTAVYFCAR | 3P10 | 1673 |
| RVTLTADTSTDTAYLELSSLRSEDTAVYFCAR | 3P10 | 1674 |
| RFTFTADTSTDTAYMELSSLRSEDTAVYFCAR | 3P10 | 1675 |
| RFTLTADTSTDTAYLELSSLRSEDTAVYFCAR | 3P10 | 1676 |
| RVTFTADTSTDTAYLELSSLRSEDTAVYFCAR | 3P10 | 1677 |
| RFTFTADTSTDTAYLELSSLRSEDTAVYFCAR | 3P10 | 1678 |
| RATITADESTSTAYMELSSLRSEDTAVYYCAR | 5F12, 25M22, 17J16 | 1679 |
| RVTLTADESTSTAYMELSSLRSEDTAVYYCAR | 5F12, 25M22, 17J16 | 1680 |
| RVTITADKSTSTAYMELSSLRSEDTAVYYCAR | 5F12, 25M22 | 1681 |
| RATLTADESTSTAYMELSSLRSEDTAVYYCAR | 5F12, 25M22, 17J16 | 1682 |
| RATITADKSTSTAYMELSSLRSEDTAVYYCAR | 5F12, 25M22 | 1683 |
| RVTLTADKSTSTAYMELSSLRSEDTAVYYCAR | 5F12, 25M22 | 1684 |
| RATLTADKSTSTAYMELSSLRSEDTAVYYCAR | 5F12, 25M22 | 1685 |
| RATITADESTSTAYMELSSLRSEDTAVYYCAR | 17J16 | 1686 |
| RVTITADESSSTAYMELSSLRSEDTAVYYCAR | 17J16 | 1687 |
| RVTITADESTSTAYLELSSLRSEDTAVYYCAR | 17J16 | 1688 |
| RVTITADESTSTAYMELSRLRSEDTAVYYCAR | 17J16 | 1689 |
| RATITADESSSTAYMELSSLRSEDTAVYYCAR | 17J16 | 1690 |
| RATITADESTSTAYLELSSLRSEDTAVYYCAR | 17J16 | 1691 |
| RATITADESTSTAYMELSRLRSEDTAVYYCAR | 17J16 | 1692 |
| RVTLTADESSSTAYMELSSLRSEDTAVYYCAR | 17J16 | 1693 |
| RVTLTADESTSTAYLELSSLRSEDTAVYYCAR | 17J16 | 1694 |
| RVTLTADESTSTAYMELSRLRSEDTAVYYCAR | 17J16 | 1695 |
| RVTITADESSSTAYLELSSLRSEDTAVYYCAR | 17J16 | 1696 |
| RVTITADESSSTAYMELSRLRSEDTAVYYCAR | 17J16 | 1697 |
| RVTITADESTSTAYLELSRLRSEDTAVYYCAR | 17J16 | 1698 |
| RATLTADESSSTAYMELSSLRSEDTAVYYCAR | 17J16 | 1699 |
| RATLTADESTSTAYLELSSLRSEDTAVYYCAR | 17J16 | 1700 |
| RATLTADESTSTAYMELSRLRSEDTAVYYCAR | 17J16 | 1701 |
| RATITADESSSTAYLELSSLRSEDTAVYYCAR | 17J16 | 1702 |
| RATITADESSSTAYMELSRLRSEDTAVYYCAR | 17J16 | 1703 |

TABLE 25-continued

Exemplary Framework Sequences for Humanized Anti-GFRAL Antibodies

| | | |
|---|---|---|
| RATITADESTSTAYLELSRLRSEDTAVYYCAR | 17J16 | 1704 |
| RVTLTADESSSTAYLELSSLRSEDTAVYYCAR | 17J16 | 1705 |
| RVTLTADESSSTAYMELSRLRSEDTAVYYCAR | 17J16 | 1706 |
| RVTLTADESTSTAYLELSRLRSEDTAVYYCAR | 17J16 | 1707 |
| RVTITADESSSTAYLELSRLRSEDTAVYYCAR | 17J16 | 1708 |
| RATLTADESSSTAYLELSSLRSEDTAVYYCAR | 17J16 | 1709 |
| RATLTADESSSTAYMELSRLRSEDTAVYYCAR | 17J16 | 1710 |
| RATLTADESTSTAYLELSRLRSEDTAVYYCAR | 17J16 | 1711 |
| RATITADESSSTAYLELSRLRSEDTAVYYCAR | 17J16 | 1712 |
| RVTLTADESSSTAYLELSRLRSEDTAVYYCAR | 17J16 | 1713 |
| RATLTADESSSTAYLELSRLRSEDTAVYYCAR | 17J16 | 1714 |
| RVTITRDTSASTAYMELSSLRSEDTAVYYCAR | 5F12 | 1715 |
| RATITRDESASTAYMELSSLRSEDTAVYYCAR | 5F12 | 1716 |
| RVTLTRDESASTAYMELSSLRSEDTAVYYCAR | 5F12 | 1717 |
| RVTITRDKSASTAYMELSSLRSEDTAVYYCAR | 5F12 | 1718 |
| RATLTRDESASTAYMELSSLRSEDTAVYYCAR | 5F12 | 1719 |
| RATITRDKSASTAYMELSSLRSEDTAVYYCAR | 5F12 | 1720 |
| RVTLTRDKSASTAYMELSSLRSEDTAVYYCAR | 5F12 | 1721 |
| RATLTRDKSASTAYMELSSLRSEDTAVYYCAR | 5F12 | 1722 |
| QVTISADKSISTAYLQWSSLKASDTAMYYCAR | 25M22 | 1723 |
| QATISADKSISTAYLQWSSLKASDTAMYYCAR | 25M22 | 1724 |
| QVTLSADKSISTAYLQWSSLKASDTAMYYCAR | 25M22 | 1725 |
| QATLSADKSISTAYLQWSSLKASDTAMYYCAR | 25M22 | 1726 |
| VH Framework 4 (FR4) | | |
| WGQGTLVTVSS | 1C1, 3P10, 5F12 | 1727 |
| WGQGTTVTVSS | 3P10, 25M22, 17J16 | 1728 |

| VL | Humanized Clone | SEQ ID NO: |
|---|---|---|
| VL Framework 1 (FR1) | | |
| DVVMTQSPLSLPVTLGQPASISC | 1C1, 3P10, 5F12, 25M22, 17J16 | 1729 |
| DVVLTQSPLSLPVTLGQPASISC | 1C1, 3P10, 5F12, 25M22, 17J16 | 1730 |
| DVVLTQSPLSLPVTLGDPASISC | 1C1 | 1731 |
| DVVLTQSPLSLPVTLGDPASISC | 1C1 | 1732 |
| DIVMTQSPLSLPVTLGQPASISC | 3P10, 5F12 | 1733 |
| DIVLTQSPLSLPVTLGQPASISC | 3P10, 5F12 | 1734 |
| DVAMTQSPLSLPVTLGQPASISC | 17J16 | 1735 |
| DVALTQSPLSLPVTLGQPASISC | 17J16 | 1736 |
| DVVLTQTPLSLPVSPGDQASISC | 1C1 | 1737 |

TABLE 25-continued

Exemplary Framework Sequences for Humanized Anti-GFRAL Antibodies

| Sequence | Antibody | SEQ ID |
|---|---|---|
| DIVMTQTPLSLPVSPGDQASISC | 1C1 | 1738 |
| DIVMTQTPLSLPVSPGDQASISC | 1C1 | 1739 |
| DIVMTQTPLSLPVSPGDQASISC | 1C1 | 1740 |
| DIELTQSPASLAVSLGQRATISC | 3P10 | 1741 |
| DIVLTQSPASLAVSLGQRATISC | 3P10 | 1742 |
| DIVMTQSPDSLAVSLGERATINC | 5F12 | 1743 |
| DIVLTQSPDSLAVSLGERATINC | 5F12 | 1744 |
| DIQMTQSPSSLSASVGDRVTITC | 5F12 | 1745 |
| DIQLTQSPSSLSASVGDRVTITC | 5F12 | 1746 |
| EIVLTQSPATLSLSPGERATLSC | 5F12 | 1747 |
| EIVLTQSPATLSVSPGERATLSC | 5F12 | 1748 |
| EIVLTQSPGTLSLSPGERATLSC | 25M22 | 1749 |
| EVVLTQSPGTLSLSPGERATLSC | 25M22 | 1750 |
| VL Framework 2 (FR2) | | |
| WFQQRPGQSPRRLIY | 1C1, 3P10, 5F12, 25M22, 17J16 | 1751 |
| WYQQRPGQSPRRLIY | 1C1, 5F12, 25M22 | 1752 |
| WFQQKPGQSPRRLIY | 1C1 | 1753 |
| WFQQRPGQSPKRLIY | 1C1, 17J16 | 1754 |
| WFQQRPGQSPRLLIY | 1C1, 3P10, 5F12, 25M22 | 1755 |
| WYQQKPGQSPRRLIY | 1C1 | 1756 |
| WYQQRPGQSPKRLIY | 1C1 | 1757 |
| WYQQRPGQSPRLLIY | 1C1, 5F12, 25M22 | 1758 |
| WFQQKPGQSPKRLIY | 1C1 | 1759 |
| WFQQKPGQSPRLLIY | 1C1 | 1760 |
| WFQQRPGQSPKLLIY | 1C1 | 1761 |
| WYQQKPGQSPKRLIY | 1C1 | 1762 |
| WYQQKPGQSPRLLIY | 1C1 | 1763 |
| WYQQRPGQSPKLLIY | 1C1 | 1764 |
| WFQQKPGQSPKLLIY | 1C1 | 1765 |
| WYQQKPGQSPKLLIY | 1C1 | 1766 |
| WLQQRPGQSPRRLIY | 17J16 | 1767 |
| WLQQRPGQSPKRLIY | 17J16 | 1768 |
| WFQQRPGQSPRRLIF | 25M22 | 1769 |
| WYQQRPGQSPRRLIF | 25M22 | 1770 |
| WFQQRPGQSPRLLIF | 25M22 | 1771 |
| WYQQRPGQSPRLLIF | 25M22 | 1772 |
| WYLQKPGQSPKLLIY | 1C1 | 1773 |
| WYQQKPGQPPKLLIY | 3P10, 5F12 | 1774 |

TABLE 25-continued

Exemplary Framework Sequences for Humanized Anti-GFRAL Antibodies

| Sequence | Antibody | SEQ ID NO |
|---|---|---|
| WYQQKPGKAPKLLIY | 5F12 | 1775 |
| WYQQKPGQAPRLLIY | 5F12, 25M22 | 1776 |
| WYQQKPGQAPRLLIF | 25M22 | 1777 |
| VL Framework 3 (FR3) | | |
| GVPDRFSGSGSGTDFTLKISRVEAEDVGVYYC | 1C1, 3P10, 5F12, 25M22, 17J16 | 1778 |
| GVPDRFSGSGSGADFTLKISRVEAEDVGVYYC | 17J16 | 1779 |
| GVPDRFSGSGSGTDFTLKISRVEAEDVGVYFC | 1C1, 3P10 | 1780 |
| GVPDRFSGSGSRTDFTLKISRVEAEDVGVYYC | 5F12 | 1781 |
| GVPDRFSGSGSGTDFTLTISSLQAEDVAVYYC | 5F12 | 1782 |
| GVPDRFSGSGSRTDFTLTISSLQAEDVAVYYC | 5F12 | 1783 |
| GVPDRFSGSGSGTDFTLTISSVQAEDVAVYYC | 5F12 | 1784 |
| GVPDRFSGSGSRTDFTLTISSVQAEDVAVYYC | 5F12 | 1785 |
| GVPSRFSGSGSGTDFTLTISSLQPEDFATYYC | 5F12 | 1786 |
| GVPSRFSGSGSGTDFTLTISSVQPEDFATYYC | 5F12 | 1787 |
| GIPARFSGSGSGTDFTLTISSLEPEDFAVYYC | 5F12 | 1788 |
| GVPARFSGSGSGTDFTLTISSLEPEDFAVYYC | 5F12 | 1789 |
| GIPARFSGSGSGTDFTLTISSVEPEDFAVYYC | 5F12 | 1790 |
| GVPARFSGSGSGTDFTLTISSVEPEDFAVYYC | 5F12 | 1791 |
| GIPDRFSGSGSGTDFTLTISRLEPEDFAVYYC | 25M22 | 1792 |
| VL Framework 4 (FR4) | | |
| FGGGTKVEIK | 1C1, 3P10, 5F12, 25M22, 17J16 | 1793 |
| FGSGTKLEIK | 1C1, 3P10 | 1794 |

In certain embodiments, an antibody or fragment thereof described herein comprises a VH region that comprises: (1) a VH FR1 having an amino acid sequence selected from SEQ ID NOS: 570-578; (2) a VH FR2 having an amino acid sequence selected from SEQ ID NOS: 579-602; (3) a VH FR3 having an amino acid sequence selected from SEQ ID NOS: 603-1726; and/or (4) a VH FR4 having an amino acid selected from SEQ ID NOS: 1727-1728. Accordingly, in some aspects, the humanized antibody comprises a VH region that includes a VH FR1 having an amino acid sequence selected from SEQ ID NOS: 570-578. In some aspects, the humanized antibody comprises a VH region that includes a VH FR2 having an amino acid sequence selected from SEQ ID NOS: 579-602. In some aspects, the humanized antibody comprises a VH region that includes a VH FR3 having an amino acid sequence selected from SEQ ID NOS: 603-1726. In some aspects, the humanized antibody comprises a VH region that includes a VH FR4 having an amino acid selected from SEQ ID NOS: 1727-1728.

In certain embodiments, an antibody or fragment thereof described herein comprises a VL region that comprises: (1) a VL FR1 having an amino acid sequence selected from SEQ ID NOS: 1729-1750; (2) a VL FR2 having an amino acid sequence selected from SEQ ID NOS: 1751-1777; (3) a VL FR3 having an amino acid sequence selected from SEQ ID NOS: 1778-1792; and/or (4) a VL FR4 having an amino acid selected from SEQ ID NOS: 1793-1794. Accordingly, in some aspects, the humanized antibody comprises a VL region that includes a VL FR1 having an amino acid sequence selected from SEQ ID NOS: 1729-1750. In some aspects, the humanized antibody comprises a VL region that includes a VL FR2 having an amino acid sequence selected from SEQ ID NOS: 1751-1777. In some aspects, the humanized antibody comprises a VL region that includes a VL FR3 having an amino acid sequence selected from SEQ ID NOS: 1778-1792. In some aspects, the humanized antibody comprises a VL region that includes a VL FR4 having an amino acid selected from SEQ ID NOS: 1793-1794.

In certain embodiments, an antibody or fragment thereof described herein comprises a VH region and a VL region, wherein the VH region further comprises: (1) a VH FR1 having an amino acid sequence selected from SEQ ID NOS: 570-578; (2) a VH FR2 having an amino acid sequence selected from SEQ ID NOS: 579-602; (3) a VH FR3 having an amino acid sequence selected from SEQ ID NOS: 603-1726; and/or (4) a VH FR4 having an amino acid sequence of SEQ ID NOS: 1727-1728; and wherein the VL region further comprises: (1) a VL FR1 having an amino acid sequence selected from SEQ ID NOS: 1729-1750; (2) a VL FR2 having an amino acid sequence selected from SEQ ID NOS: 1751-1777; (3) a VL FR3 having an amino acid sequence selected from SEQ ID NOS: 1778-1792; and/or (4) a VL FR4 having an amino acid selected from SEQ ID NOS: 1793-1794.

Also provided herein are antibodies comprising one or more (e.g., one, two, three or four) VH FRs and one or more (e.g., one, two, three or four) VL FRs listed in Table 25. In particular, provided herein is an antibody comprising: a VH FR1 (SEQ ID NOS:570-578) and a VL FR1 (SEQ ID NOS:1729-1750); a VH FR1 (SEQ ID NOS:570-578) and a VL FR2 (SEQ ID NOS:1751-1777); a VH FR1 (SEQ ID NOS:570-578) and a VL FR3 (SEQ ID NOS:1778-1792); a VH FR1 (SEQ ID NOS:570-578) and a VL FR4 (SEQ ID NOS:1793-1794); a VH FR2 (SEQ ID NOS:579-602) and a VL FR1 (SEQ ID NOS:1729-1750); a VH FR2 (SEQ ID NOS:579-602) and a VL FR2 (SEQ ID NOS:1751-1777); a VH FR2 (SEQ ID NOS:579-602) and a VL FR3 (SEQ ID NOS:1778-1792); a VH FR2 (SEQ ID NOS:579-602) and a VL FR4 (SEQ ID NOS:1793-1794); a VH FR3 (SEQ ID NOS:603-1726) and a VL FR1 (SEQ ID NOS:1729-1750); a VH FR3 (SEQ ID NOS:603-1726) and a VL FR2 (SEQ ID NOS:1751-1777); a VH FR3 (SEQ ID NOS:603-1726) and a VL FR3 (SEQ ID NOS:1778-1792); a VH FR3 (SEQ ID NOS:603-1726) and a VL FR4 (SEQ ID NOS:1793-1794); a VH FR4 (SEQ ID NOS:1727-1728) and a VL FR1 (SEQ ID NOS:1729-1750); a VH FR4 (SEQ ID NOS:1727-1728) and a VL FR2 (SEQ ID NOS:1751-1777); a VH FR4 (SEQ ID NOS:1727-1728) and a VL FR3 (SEQ ID NOS:1778-1792); a VH FR4 (SEQ ID NOS:1727-1728) and a VL FR4 (SEQ ID NOS:1793-1794); a VH FR1 (SEQ ID NOS:570-578), a VH FR2 (SEQ ID NOS:579-602) and a VL FR1 (SEQ ID NOS:1729-1750); a VH FR1 (SEQ ID NOS:570-578), a VH FR2 (SEQ ID NOS:579-602) and a VL FR2 (SEQ ID NOS:1751-1777); a VH FR1 (SEQ ID NOS:570-578), a VH FR2 (SEQ ID NOS:579-602) and a VL FR3 (SEQ ID NOS:1778-1792); a VH FR1 (SEQ ID NOS:570-578), a VH FR2 (SEQ ID NOS:579-602) and a VL FR4 (SEQ ID NOS:1793-1794); a VH FR2 (SEQ ID NOS:579-602), a VH FR3 (SEQ ID NOS:603-1726) and a VL FR1 (SEQ ID NOS:1729-1750); a VH FR2 (SEQ ID NOS:579-602), a VH FR3 (SEQ ID NOS:603-1726) and a VL FR2 (SEQ ID NOS:1751-1777); a VH FR2 (SEQ ID NOS:579-602), a VH FR3 (SEQ ID NOS:603-1726) and a VL FR3 (SEQ ID NOS:1778-1792); a VH FR2 (SEQ ID NOS:579-602), a VH FR3 (SEQ ID NOS:603-1726) and a VL FR4 (SEQ ID NOS:1793-1794); a VH FR1 (SEQ ID NOS:570-578), a VL FR1 (SEQ ID NOS:1729-1750) and a VL FR2 (SEQ ID NOS:1751-1777); a VH FR1 (SEQ ID NOS:570-578), a VL FR1 (SEQ ID NOS:1729-1750) and a VL FR3 (SEQ ID NOS:1778-1792); a VH FR1 (SEQ ID NOS:570-578), a VL FR1 (SEQ ID NOS:1729-1750) and a VL FR4 (SEQ ID NOS:1793-1794); a VH FR1 (SEQ ID NOS:570-578), a VL FR2 (SEQ ID NOS:1751-1777) and a VL FR3 (SEQ ID NOS:1778-1792); a VH FR1 (SEQ ID NOS:570-578), a VL FR2 (SEQ ID NOS:1751-1777) and a VL FR4 (SEQ ID NOS:1793-1794); a VH FR2 (SEQ ID NOS:579-602), a VL FR1 (SEQ ID NOS:1729-1750) and a VL FR2 (SEQ ID NOS:1751-1777); a VH FR2 (SEQ ID NOS:579-602), a VL FR1 (SEQ ID NOS:1729-1750) and a VL FR3 (SEQ ID NOS:1778-1792); a VH FR2 (SEQ ID NOS:579-602), a VL FR1 (SEQ ID NOS:1729-1750) and a VL FR4 (SEQ ID NOS:1793-1794); a VH FR2 (SEQ ID NOS:579-602), a VL FR2 (SEQ ID NOS:1751-1777) and a VL FR3 (SEQ ID NOS:1778-1792); a VH FR2 (SEQ ID NOS:579-602), a VL FR2 (SEQ ID NOS:1751-1777) and a VL FR4 (SEQ ID NOS:1793-1794); a VH FR3 (SEQ ID NOS:603-1726), a VL FR1 (SEQ ID NOS:1729-1750) and a VL FR2 (SEQ ID NOS:1751-1777); a VH FR3 (SEQ ID NOS:603-1726), a VL FR1 (SEQ ID NOS:1729-1750) and a VL FR3 (SEQ ID NOS:1778-1792); a VH FR3 (SEQ ID NOS:603-1726), a VL FR1 (SEQ ID NOS:1729-1750) and a VL FR4 (SEQ ID NOS:1793-1794); a VH FR3 (SEQ ID NOS:603-1726), a VL FR2 (SEQ ID NOS:1751-1777) and a VL FR3 (SEQ ID NOS:1778-1792); a VH FR3 (SEQ ID NOS:603-1726), a VL FR2 (SEQ ID NOS:1751-1777) and a VL FR4 (SEQ ID NOS:1793-1794); a VH FR4 (SEQ ID NOS:1727-1728), a VL FR1 (SEQ ID NOS:1729-1750) and a VL FR2 (SEQ ID NOS:1751-1777); a VH FR4 (SEQ ID NOS:1727-1728), a VL FR1 (SEQ ID NOS:1729-1750) and a VL FR3 (SEQ ID NOS:1778-1792); a VH FR4 (SEQ ID NOS:1727-1728), a VL FR1 (SEQ ID NOS:1729-1750) and a VL FR4 (SEQ ID NOS:1793-1794); a VH FR4 (SEQ ID NOS:1727-1728), a VL FR2 (SEQ ID NOS:1751-1777) and a VL FR3 (SEQ ID NOS:1778-1792); a VH FR4 (SEQ ID NOS:1727-1728), a VL FR2 (SEQ ID NOS:1751-1777) and a VL FR4 (SEQ ID NOS:1793-1794); a VH FR1 (SEQ ID NOS:570-578), a VH FR2 (SEQ ID NOS:579-602), a VH FR3 (SEQ ID NOS:603-1726) and a VL FR1 (SEQ ID NOS:1729-1750); a VH FR1 (SEQ ID NOS:570-578), a VH FR2 (SEQ ID NOS:579-602), a VH FR3 (SEQ ID NOS:603-1726) and a VL FR2 (SEQ ID NOS:1751-1777); a VH FR1 (SEQ ID NOS:570-578), a VH FR2 (SEQ ID NOS:579-602), a VH FR3 (SEQ ID NOS:603-1726) and a VL FR3 (SEQ ID NOS:1778-1792); a VH FR1 (SEQ ID NOS:570-578), a VH FR2 (SEQ ID NOS:579-602), a VH FR3 (SEQ ID NOS: 603-1726) and a VL FR4 (SEQ ID NOS:1793-1794); a VH FR1 (SEQ ID NOS:570-578), a VH FR2 (SEQ ID NOS: 579-602), a VH FR4 (SEQ ID NOS:1727-1728) and a VL FR1 (SEQ ID NOS:1729-1750); a VH FR1 (SEQ ID NOS: 570-578), a VH FR2 (SEQ ID NOS:579-602), a VH FR4 (SEQ ID NOS:1727-1728) and a VL FR2 (SEQ ID NOS: 1751-1777); a VH FR1 (SEQ ID NOS:570-578), a VH FR2 (SEQ ID NOS:579-602), a VH FR4 (SEQ ID NOS:1727-1728) and a VL FR3 (SEQ ID NOS:1778-1792); a VH FR1 (SEQ ID NOS:570-578), a VH FR2 (SEQ ID NOS:579-602), a VH FR4 (SEQ ID NOS:1727-1728) and a VL FR4 (SEQ ID NOS:1793-1794); a VH FR1 (SEQ ID NOS:570-578), a VH FR3 (SEQ ID NOS:603-1726), a VH FR4 (SEQ ID NOS:1727-1728) and a VL FR1 (SEQ ID NOS:1729-1750); a VH FR1 (SEQ ID NOS:570-578), a VH FR3 (SEQ ID NOS:603-1726), a VH FR4 (SEQ ID NOS:1727-1728) and a VL FR2 (SEQ ID NOS:1751-1777); a VH FR1 (SEQ ID NOS:570-578), a VH FR3 (SEQ ID NOS:603-1726), a VH FR4 (SEQ ID NOS:1727-1728) and a VL FR3 (SEQ ID NOS:1778-1792); a VH FR1 (SEQ ID NOS:570-578), a VH FR3 (SEQ ID NOS:603-1726), a VH FR4 (SEQ ID NOS: 1727-1728) and a VL FR4 (SEQ ID NOS:1793-1794); a VH FR2 (SEQ ID NOS:579-602), a VH FR3 (SEQ ID NOS: 603-1726), a VH FR4 (SEQ ID NOS:1727-1728) and a VL FR1 (SEQ ID NOS:1729-1750); a VH FR2 (SEQ ID NOS: 579-602), a VH FR3 (SEQ ID NOS:603-1726), a VH FR4 (SEQ ID NOS:1727-1728) and a VL FR2 (SEQ ID NOS: 1751-1777); a VH FR2 (SEQ ID NOS:579-602), a VH FR3 (SEQ ID NOS:603-1726), a VH FR4 (SEQ ID NOS:1727-1728) and a VL FR3 (SEQ ID NOS:1778-1792); a VH FR2 (SEQ ID NOS:579-602), a VH FR3 (SEQ ID NOS:603-1726), a VH FR4 (SEQ ID NOS:1727-1728) and a VL FR4 (SEQ ID NOS:1793-1794); a VH FR1 (SEQ ID NOS:570-578), a VH FR2 (SEQ ID NOS:579-602), a VL FR1 (SEQ ID NOS:1729-1750) and a VL FR2 (SEQ ID NOS:1751-1777); a VH FR1 (SEQ ID NOS:570-578), a VH FR2 (SEQ ID NOS:579-602), a VL FR1 (SEQ ID NOS:1729-1750) and a VL FR3 (SEQ ID NOS:1778-1792); a VH FR1 (SEQ ID NOS:570-578), a VH FR2 (SEQ ID NOS:579-602), a VL FR1 (SEQ ID NOS:1729-1750) and a VL FR4 (SEQ ID NOS:1793-1794); a VH FR1 (SEQ ID NOS:570-578), a VH FR3 (SEQ ID NOS:603-1726), a VL FR1 (SEQ ID NOS: 1729-1750) and a VL FR2 (SEQ ID NOS:1751-1777); a VH FR1 (SEQ ID NOS:570-578), a VH FR3 (SEQ ID NOS: 603-1726), a VL FR1 (SEQ ID NOS:1729-1750) and a VL FR3 (SEQ ID NOS:1778-1792); a VH FR1 (SEQ ID NOS: 570-578), a VH FR3 (SEQ ID NOS:603-1726), a VL FR1 (SEQ ID NOS:1729-1750) and a VL FR4 (SEQ ID NOS: 1793-1794); a VH FR1 (SEQ ID NOS:570-578), a VH FR4 (SEQ ID NOS:1727-1728), a VL FR1 (SEQ ID NOS:1729-1750) and a VL FR2 (SEQ ID NOS:1751-1777); a VH FR1 (SEQ ID NOS:570-578), a VH FR4 (SEQ ID NOS:1727-1728), a VL FR1 (SEQ ID NOS:1729-1750) and a VL FR3 (SEQ ID NOS:1778-1792); a VH FR1 (SEQ ID NOS:570-578), a VH FR4 (SEQ ID NOS:1727-1728), a VL FR1 (SEQ ID NOS:1729-1750) and a VL FR4 (SEQ ID NOS:1793-1794); a VH FR2 (SEQ ID NOS:579-602), a VH FR3 (SEQ ID NOS:603-1726), a VL FR1 (SEQ ID NOS:1729-1750) and a VL FR2 (SEQ ID NOS:1751-1777); a VH FR2 (SEQ ID NOS:579-602), a VH FR3 (SEQ ID NOS:603-1726), a VL FR1 (SEQ ID NOS:1729-1750) and a VL FR3 (SEQ ID NOS:1778-1792); a VH FR2 (SEQ ID NOS:579-602), a VH FR3 (SEQ ID NOS:603-1726), a VL FR1 (SEQ ID NOS: 1729-1750) and a VL FR4 (SEQ ID NOS:1793-1794); a VH FR2 (SEQ ID NOS:579-602), a VH FR4 (SEQ ID NOS: 1727-1728), a VL FR1 (SEQ ID NOS:1729-1750) and a VL FR2 (SEQ ID NOS:1751-1777); a VH FR2 (SEQ ID NOS: 579-602), a VH FR4 (SEQ ID NOS:1727-1728), a VL FR1 (SEQ ID NOS:1729-1750) and a VL FR3 (SEQ ID NOS: 1778-1792); a VH FR2 (SEQ ID NOS:579-602), a VH FR4 (SEQ ID NOS:1727-1728), a VL FR1 (SEQ ID NOS:1729-1750) and a VL FR4 (SEQ ID NOS:1793-1794); a VH FR3 (SEQ ID NOS:603-1726), a VH FR4 (SEQ ID NOS:1727-1728), a VL FR1 (SEQ ID NOS:1729-1750) and a VL FR2 (SEQ ID NOS:1751-1777); a VH FR3 (SEQ ID NOS:603-1726), a VH FR4 (SEQ ID NOS:1727-1728), a VL FR1 (SEQ ID NOS:1729-1750) and a VL FR3 (SEQ ID NOS: 1778-1792); a VH FR3 (SEQ ID NOS:603-1726), a VH FR4 (SEQ ID NOS:1727-1728), a VL FR1 (SEQ ID NOS:1729-1750) and a VL FR4 (SEQ ID NOS:1793-1794); a VH FR1 (SEQ ID NOS:570-578), a VH FR2 (SEQ ID NOS:579-602), a VL FR2 (SEQ ID NOS:1751-1777) and a VL FR3 (SEQ ID NOS:1778-1792); a VH FR1 (SEQ ID NOS:570-578), a VH FR2 (SEQ ID NOS:579-602), a VL FR2 (SEQ ID NOS:1751-1777) and a VL FR4 (SEQ ID NOS:1793-1794); a VH FR1 (SEQ ID NOS:570-578), a VH FR3 (SEQ ID NOS:603-1726), a VL FR2 (SEQ ID NOS:1751-1777) and a VL FR3 (SEQ ID NOS:1778-1792); a VH FR1 (SEQ ID NOS:570-578), a VH FR3 (SEQ ID NOS:603-1726), a VL FR2 (SEQ ID NOS:1751-1777) and a VL FR4 (SEQ ID NOS:1793-1794); a VH FR1 (SEQ ID NOS:570-578), a VH FR4 (SEQ ID NOS:1727-1728), a VL FR2 (SEQ ID NOS: 1751-1777) and a VL FR3 (SEQ ID NOS:1778-1792); a VH FR1 (SEQ ID NOS:570-578), a VH FR4 (SEQ ID NOS:1727-1728), a VL FR2 (SEQ ID NOS:1751-1777) and a VL FR4 (SEQ ID NOS:1793-1794); a VH FR2 (SEQ ID NOS:579-602), a VH FR3 (SEQ ID NOS:603-1726), a VL FR2 (SEQ ID NOS:1751-1777) and a VL FR4 (SEQ ID NOS:1793-1794); a VH FR2 (SEQ ID NOS:579-602), a VH FR4 (SEQ ID NOS:1727-1728), a VL FR2 (SEQ ID NOS:1751-1777) and a VL FR3 (SEQ ID NOS:1778-1792); a VH FR2 (SEQ ID NOS:579-602), a VH FR4 (SEQ ID NOS:1727-1728), a VL FR2 (SEQ ID NOS:1751-1777) and a VL FR4 (SEQ ID NOS:1793-1794); a VH FR3 (SEQ ID NOS:603-1726), a VH FR4 (SEQ ID NOS:1727-1728), a VL FR2 (SEQ ID NOS:1751-1777) and a VL FR3 (SEQ ID NOS:1778-1792); a VH FR3 (SEQ ID NOS:603-1726), a VH FR4 (SEQ ID NOS:1727-1728), a VL FR2 (SEQ ID NOS:1751-1777) and a VL FR4 (SEQ ID NOS:1793-1794); a VH FR1 (SEQ ID NOS:570-578), a VH FR2 (SEQ ID NOS:579-602), a VL FR3 (SEQ ID NOS:1778-1792) and a VL FR4 (SEQ ID NOS:1793-1794); a VH FR1 (SEQ ID NOS:570-578), a VH FR3 (SEQ ID NOS:603-1726), a VL FR3 (SEQ ID NOS:1778-1792) and a VL FR4 (SEQ ID NOS:1793-1794); a VH FR1 (SEQ ID NOS:570-578), a VH FR4 (SEQ ID NOS:1727-1728), a VL FR3 (SEQ ID NOS:1778-1792) and a VL FR4 (SEQ ID NOS:1793-1794); a VH FR2 (SEQ ID NOS:579-602), a VH FR3 (SEQ ID NOS:603-1726), a VL FR3 (SEQ ID NOS: 1778-1792) and a VL FR4 (SEQ ID NOS:1793-1794); a VH FR2 (SEQ ID NOS:579-602), a VH FR4 (SEQ ID NOS: 1727-1728), a VL FR3 (SEQ ID NOS:1778-1792) and a VL FR4 (SEQ ID NOS:1793-1794); a VH FR3 (SEQ ID NOS: 603-1726), a VH FR4 (SEQ ID NOS:1727-1728), a VL FR3 (SEQ ID NOS:1778-1792) and a VL FR4 (SEQ ID NOS: 1793-1794); a VH FR1 (SEQ ID NOS:570-578), a VL FR1 (SEQ ID NOS:1729-1750), a VL FR2 (SEQ ID NOS:1751-1777) and a VL FR3 (SEQ ID NOS:1778-1792); a VH FR1 (SEQ ID NOS:570-578), a VL FR1 (SEQ ID NOS:1729-1750), a VL FR2 (SEQ ID NOS:1751-1777) and a VL FR4 (SEQ ID NOS:1793-1794); a VH FR1 (SEQ ID NOS:570-578), a VL FR1 (SEQ ID NOS:1729-1750), a VL FR3 (SEQ ID NOS:1778-1792) and a VL FR4 (SEQ ID NOS:1793-1794); a VH FR1 (SEQ ID NOS:570-578), a VL FR2 (SEQ ID NOS:1751-1777), a VL FR3 (SEQ ID NOS:1778-1792) and a VL FR4 (SEQ ID NOS:1793-1794); a VH FR2 (SEQ ID NOS:579-602), a VL FR1 (SEQ ID NOS:1729-1750), a VL FR2 (SEQ ID NOS:1751-1777) and a VL FR3 (SEQ ID NOS:1778-1792); a VH FR2 (SEQ ID NOS:579-602), a VL FR1 (SEQ ID NOS:1729-1750), a VL FR2 (SEQ ID NOS: 1751-1777) and a VL FR4 (SEQ ID NOS:1793-1794); a VH FR2 (SEQ ID NOS:579-602), a VL FR1 (SEQ ID NOS: 1729-1750), a VL FR3 (SEQ ID NOS:1778-1792) and a VL FR4 (SEQ ID NOS:1793-1794); a VH FR2 (SEQ ID NOS: 579-602), a VL FR2 (SEQ ID NOS:1751-1777), a VL FR3 (SEQ ID NOS:1778-1792) and a VL FR4 (SEQ ID NOS: 1793-1794); a VH FR3 (SEQ ID NOS:603-1726), a VL FR1 (SEQ ID NOS:1729-1750), a VL FR2 (SEQ ID NOS:1751-1777) and a VL FR3 (SEQ ID NOS:1778-1792); a VH FR3 (SEQ ID NOS:603-1726), a VL FR1 (SEQ ID NOS:1729-1750), a VL FR2 (SEQ ID NOS:1751-1777) and a VL FR4 (SEQ ID NOS:1793-1794); a VH FR3 (SEQ ID NOS:603-1726), a VL FR1 (SEQ ID NOS:1729-1750), a VL FR3 (SEQ ID NOS:1778-1792) and a VL FR4 (SEQ ID NOS: 1793-1794); a VH FR3 (SEQ ID NOS:603-1726), a VL FR2 (SEQ ID NOS:1751-1777), a VL FR3 (SEQ ID NOS:1778-1792) and a VL FR4 (SEQ ID NOS:1793-1794); a VH FR4 (SEQ ID NOS:1727-1728), a VL FR1 (SEQ ID NOS:1729-1750), a VL FR2 (SEQ ID NOS:1751-1777) and a VL FR3 (SEQ ID NOS:1778-1792); a VH FR4 (SEQ ID NOS:1727-1728), a VL FR1 (SEQ ID NOS:1729-1750), a VL FR2 (SEQ ID NOS:1751-1777) and a VL FR4 (SEQ ID NOS:1793-1794); a VH FR4 (SEQ ID NOS:1727-1728), a VL FR1 (SEQ ID NOS:1729-1750), a VL FR3 (SEQ ID NOS:1778-1792) and a VL FR4 (SEQ ID NOS:1793-1794); a VH FR4 (SEQ ID NOS:1727-1728), a VL FR2 (SEQ ID NOS: 1751-1777), a VL FR3 (SEQ ID NOS:1778-1792) and a VL FR4 (SEQ ID NOS:1793-1794); a VH FR1 (SEQ ID NOS: 570-578), a VH FR2 (SEQ ID NOS:579-602), a VH FR3

(SEQ ID NOS:603-1726), a VH FR4 (SEQ ID NOS:1727-1728) and a VL FR1 (SEQ ID NOS:1729-1750); a VH FR1 (SEQ ID NOS:570-578), a VH FR2 (SEQ ID NOS:579-602), a VH FR3 (SEQ ID NOS:603-1726), a VH FR4 (SEQ ID NOS:1727-1728) and a VL FR2 (SEQ ID NOS:1751-1777); a VH FR1 (SEQ ID NOS:570-578), a VH FR2 (SEQ ID NOS:579-602), a VH FR3 (SEQ ID NOS:603-1726), a VH FR4 (SEQ ID NOS:1727-1728) and a VL FR3 (SEQ ID NOS:1778-1792); a VH FR1 (SEQ ID NOS:570-578), a VH FR2 (SEQ ID NOS:579-602), a VH FR3 (SEQ ID NOS:603-1726), a VH FR4 (SEQ ID NOS:1727-1728) and a VL FR4 (SEQ ID NOS:1793-1794); a VH FR1 (SEQ ID NOS:570-578), a VH FR2 (SEQ ID NOS:579-602), a VH FR3 (SEQ ID NOS:603-1726), a VL FR1 (SEQ ID NOS:1729-1750) and a VL FR2 (SEQ ID NOS:1751-1777); a VH FR1 (SEQ ID NOS:570-578), a VH FR2 (SEQ ID NOS:579-602), a VH FR3 (SEQ ID NOS:603-1726), a VL FR1 (SEQ ID NOS:1729-1750) and a VL FR3 (SEQ ID NOS:1778-1792); a VH FR1 (SEQ ID NOS:570-578), a VH FR2 (SEQ ID NOS:579-602), a VH FR3 (SEQ ID NOS:603-1726), a VL FR1 (SEQ ID NOS:1729-1750) and a VL FR4 (SEQ ID NOS:1793-1794); a VH FR1 (SEQ ID NOS:570-578), a VH FR2 (SEQ ID NOS:579-602), a VH FR3 (SEQ ID NOS:603-1726), a VL FR2 (SEQ ID NOS:1751-1777) and a VL FR3 (SEQ ID NOS:1778-1792); a VH FR1 (SEQ ID NOS:570-578), a VH FR2 (SEQ ID NOS:579-602), a VH FR3 (SEQ ID NOS:603-1726), a VL FR2 (SEQ ID NOS:1751-1777) and a VL FR4 (SEQ ID NOS:1793-1794); a VH FR1 (SEQ ID NOS:570-578), a VH FR2 (SEQ ID NOS:579-602), a VH FR3 (SEQ ID NOS:603-1726), a VL FR3 (SEQ ID NOS:1778-1792) and a VL FR4 (SEQ ID NOS:1793-1794); a VH FR1 (SEQ ID NOS:570-578), a VH FR2 (SEQ ID NOS:579-602), a VH FR4 (SEQ ID NOS:1727-1728), a VL FR1 (SEQ ID NOS:1729-1750) and a VL FR2 (SEQ ID NOS:1751-1777); a VH FR1 (SEQ ID NOS:570-578), a VH FR2 (SEQ ID NOS:579-602), a VH FR4 (SEQ ID NOS:1727-1728), a VL FR1 (SEQ ID NOS:1729-1750) and a VL FR3 (SEQ ID NOS:1778-1792); a VH FR1 (SEQ ID NOS:570-578), a VH FR2 (SEQ ID NOS:579-602), a VH FR4 (SEQ ID NOS:1727-1728), a VL FR1 (SEQ ID NOS:1729-1750) and a VL FR4 (SEQ ID NOS:1793-1794); a VH FR1 (SEQ ID NOS:570-578), a VH FR2 (SEQ ID NOS:579-602), a VH FR4 (SEQ ID NOS:1727-1728), a VL FR2 (SEQ ID NOS:1751-1777) and a VL FR3 (SEQ ID NOS:1778-1792); a VH FR1 (SEQ ID NOS:570-578), a VH FR2 (SEQ ID NOS:579-602), a VH FR4 (SEQ ID NOS:1727-1728), a VL FR2 (SEQ ID NOS:1751-1777) and a VL FR4 (SEQ ID NOS:1793-1794); a VH FR1 (SEQ ID NOS:570-578), a VH FR2 (SEQ ID NOS:579-602), a VH FR4 (SEQ ID NOS:1727-1728), a VL FR3 (SEQ ID NOS:1778-1792) and a VL FR4 (SEQ ID NOS:1793-1794); a VH FR2 (SEQ ID NOS:579-602), a VH FR3 (SEQ ID NOS:603-1726), a VH FR4 (SEQ ID NOS:1727-1728), a VL FR1 (SEQ ID NOS:1729-1750) and a VL FR2 (SEQ ID NOS:1751-1777); a VH FR2 (SEQ ID NOS:579-602), a VH FR3 (SEQ ID NOS:603-1726), a VH FR4 (SEQ ID NOS:1727-1728), a VL FR1 (SEQ ID NOS:1729-1750) and a VL FR3 (SEQ ID NOS:1778-1792); a VH FR2 (SEQ ID NOS:579-602), a VH FR3 (SEQ ID NOS:603-1726), a VH FR4 (SEQ ID NOS:1727-1728), a VL FR1 (SEQ ID NOS:1729-1750) and a VL FR4 (SEQ ID NOS:1793-1794); a VH FR2 (SEQ ID NOS:579-602), a VH FR3 (SEQ ID NOS:603-1726), a VH FR4 (SEQ ID NOS:1727-1728), a VL FR2 (SEQ ID NOS:1751-1777) and a VL FR3 (SEQ ID NOS:1778-1792); a VH FR2 (SEQ ID NOS:579-602), a VH FR3 (SEQ ID NOS:603-1726), a VH FR4 (SEQ ID NOS:1727-1728), a VL FR2 (SEQ ID NOS:1751-1777) and a VL FR4 (SEQ ID NOS:1793-1794); a VH FR2 (SEQ ID NOS:579-602), a VH FR3 (SEQ ID NOS:603-1726), a VH FR4 (SEQ ID NOS:1727-1728), a VL FR3 (SEQ ID NOS:1778-1792) and a VL FR4 (SEQ ID NOS:1793-1794); a VH FR1 (SEQ ID NOS:570-578), a VH FR2 (SEQ ID NOS:579-602), a VL FR1 (SEQ ID NOS:1729-1750), a VL FR2 (SEQ ID NOS:1751-1777), and a VL FR3 (SEQ ID NOS:1778-1792); a VH FR1 (SEQ ID NOS:570-578), a VH FR2 (SEQ ID NOS:579-602), a VL FR1 (SEQ ID NOS:1729-1750), a VL FR2 (SEQ ID NOS:1751-1777), and a VL FR4 (SEQ ID NOS:1793-1794); a VH FR1 (SEQ ID NOS:570-578), a VH FR2 (SEQ ID NOS:579-602), a VL FR1 (SEQ ID NOS:1729-1750), a VL FR3 (SEQ ID NOS:1778-1792), and a VL FR4 (SEQ ID NOS:1793-1794); a VH FR1 (SEQ ID NOS:570-578), a VH FR2 (SEQ ID NOS:579-602), a VL FR2 (SEQ ID NOS:1751-1777), a VL FR3 (SEQ ID NOS:1778-1792), and a VL FR4 (SEQ ID NOS:1793-1794); a VH FR1 (SEQ ID NOS:570-578), a VH FR3 (SEQ ID NOS:603-1726), a VL FR1 (SEQ ID NOS:1729-1750), a VL FR2 (SEQ ID NOS:1751-1777), and a VL FR3 (SEQ ID NOS:1778-1792); a VH FR1 (SEQ ID NOS:570-578), a VH FR3 (SEQ ID NOS:603-1726), a VL FR1 (SEQ ID NOS:1729-1750), a VL FR2 (SEQ ID NOS:1751-1777), and a VL FR4 (SEQ ID NOS:1793-1794); a VH FR1 (SEQ ID NOS:570-578), a VH FR3 (SEQ ID NOS:603-1726), a VL FR1 (SEQ ID NOS:1729-1750), a VL FR3 (SEQ ID NOS:1778-1792), and a VL FR4 (SEQ ID NOS:1793-1794); a VH FR1 (SEQ ID NOS:570-578), a VH FR3 (SEQ ID NOS:603-1726), a VL FR2 (SEQ ID NOS:1751-1777), a VL FR3 (SEQ ID NOS:1778-1792), and a VL FR4 (SEQ ID NOS:1793-1794); a VH FR1 (SEQ ID NOS:570-578), a VH FR4 (SEQ ID NOS:1727-1728), a VL FR1 (SEQ ID NOS:1729-1750), a VL FR2 (SEQ ID NOS:1751-1777), and a VL FR3 (SEQ ID NOS:1778-1792); a VH FR1 (SEQ ID NOS:570-578), a VH FR4 (SEQ ID NOS:1727-1728), a VL FR1 (SEQ ID NOS:1729-1750), a VL FR2 (SEQ ID NOS:1751-1777), and a VL FR4 (SEQ ID NOS:1793-1794); a VH FR1 (SEQ ID NOS:570-578), a VH FR4 (SEQ ID NOS:1727-1728), a VL FR1 (SEQ ID NOS:1729-1750), a VL FR3 (SEQ ID NOS:1778-1792), and a VL FR4 (SEQ ID NOS:1793-1794); a VH FR1 (SEQ ID NOS:570-578), a VH FR4 (SEQ ID NOS:1727-1728), a VL FR2 (SEQ ID NOS:1751-1777), a VL FR3 (SEQ ID NOS:1778-1792), and a VL FR4 (SEQ ID NOS:1793-1794); a VH FR2 (SEQ ID NOS:579-602), a VH FR3 (SEQ ID NOS:603-1726), a VL FR1 (SEQ ID NOS:1729-1750), a VL FR2 (SEQ ID NOS:1751-1777), and a VL FR4 (SEQ ID NOS:1793-1794); a VH FR2 (SEQ ID NOS:579-602), a VH FR3 (SEQ ID NOS:603-1726), a VL FR1 (SEQ ID NOS:1729-1750), a VL FR3 (SEQ ID NOS:1778-1792), and a VL FR4 (SEQ ID NOS:1793-1794); a VH FR2 (SEQ ID NOS:579-602), a VH FR3 (SEQ ID NOS:603-1726), a VL FR2 (SEQ ID NOS:1751-1777), a VL FR3 (SEQ ID NOS:1778-1792), and a VL FR4 (SEQ ID NOS:1793-1794); a VH FR2 (SEQ ID NOS:579-602), a VH FR4 (SEQ ID NOS:1727-1728), a VL FR1 (SEQ ID NOS:1729-1750), a VL FR2 (SEQ ID NOS:1751-1777), and a VL FR3 (SEQ ID NOS:1778-1792); a VH FR2 (SEQ ID NOS:579-602), a VH FR4 (SEQ ID NOS:1727-1728), a VL FR1 (SEQ ID NOS:1729-1750), a VL FR2 (SEQ ID NOS:1751-1777), and a VL FR4 (SEQ ID NOS:1793-1794); a VH FR2 (SEQ ID NOS:579-602), a VH FR4 (SEQ ID NOS:1727-1728), a VL FR1 (SEQ ID NOS:1729-1750), a VL FR3 (SEQ ID NOS:1778-1792), and a VL FR4 (SEQ ID NOS:1793-1794); a VH FR2 (SEQ ID NOS:579-602), a VH FR4 (SEQ ID NOS:1727-1728), a VL FR2

(SEQ ID NOS:1751-1777), a VL FR3 (SEQ ID NOS:1778-1792), and a VL FR4 (SEQ ID NOS:1793-1794); a VH FR3 (SEQ ID NOS:603-1726), a VH FR4 (SEQ ID NOS:1727-1728), a VL FR1 (SEQ ID NOS:1729-1750), a VL FR2 (SEQ ID NOS:1751-1777), and a VL FR3 (SEQ ID NOS: 1778-1792); a VH FR3 (SEQ ID NOS:603-1726), a VH FR4 (SEQ ID NOS:1727-1728), a VL FR1 (SEQ ID NOS:1729-1750), a VL FR2 (SEQ ID NOS:1751-1777), and a VL FR4 (SEQ ID NOS:1793-1794); a VH FR3 (SEQ ID NOS:603-1726), a VH FR4 (SEQ ID NOS:1727-1728), a VL FR1 (SEQ ID NOS:1729-1750), a VL FR3 (SEQ ID NOS:1778-1792), and a VL FR4 (SEQ ID NOS:1793-1794); a VH FR3 (SEQ ID NOS:603-1726), a VH FR4 (SEQ ID NOS:1727-1728), a VL FR2 (SEQ ID NOS:1751-1777), a VL FR3 (SEQ ID NOS:1778-1792), and a VL FR4 (SEQ ID NOS:1793-1794); a VH FR1 (SEQ ID NOS:570-578), a VL FR1 (SEQ ID NOS:1729-1750), a VL FR2 (SEQ ID NOS:1751-1777), a VL FR3 (SEQ ID NOS:1778-1792), and a VL FR4 (SEQ ID NOS:1793-1794); a VH FR2 (SEQ ID NOS:579-602), a VL FR1 (SEQ ID NOS:1729-1750), a VL FR2 (SEQ ID NOS:1751-1777), a VL FR3 (SEQ ID NOS:1778-1792), and a VL FR4 (SEQ ID NOS:1793-1794); a VH FR3 (SEQ ID NOS:603-1726), a VL FR1 (SEQ ID NOS:1729-1750), a VL FR2 (SEQ ID NOS:1751-1777), a VL FR3 (SEQ ID NOS:1778-1792), and a VL FR4 (SEQ ID NOS:1793-1794); a VH FR4 (SEQ ID NOS:1727-1728), a VL FR1 (SEQ ID NOS:1729-1750), a VL FR2 (SEQ ID NOS:1751-1777), a VL FR3 (SEQ ID NOS:1778-1792), and a VL FR4 (SEQ ID NOS:1793-1794); a VH FR1 (SEQ ID NOS:570-578), a VH FR2 (SEQ ID NOS:579-602), a VH FR3 (SEQ ID NOS: 603-1726), a VH FR4 (SEQ ID NOS:1727-1728), VL FR1 (SEQ ID NOS:1729-1750) and a VL FR2 (SEQ ID NOS: 1751-1777); a VH FR1 (SEQ ID NOS:570-578), a VH FR2 (SEQ ID NOS:579-602), a VH FR3 (SEQ ID NOS:603-1726), a VH FR4 (SEQ ID NOS:1727-1728), VL FR1 (SEQ ID NOS:1729-1750) and a VL FR3 (SEQ ID NOS:1778-1792); a VH FR1 (SEQ ID NOS:570-578), a VH FR2 (SEQ ID NOS:579-602), a VH FR3 (SEQ ID NOS:603-1726), a VH FR4 (SEQ ID NOS:1727-1728), VL FR1 (SEQ ID NOS:1729-1750) and a VL FR4 (SEQ ID NOS:1793-1794); a VH FR1 (SEQ ID NOS:570-578), a VH FR2 (SEQ ID NOS:579-602), a VH FR3 (SEQ ID NOS:603-1726), a VH FR4 (SEQ ID NOS:1727-1728), VL FR2 (SEQ ID NOS:1751-1777) and a VL FR3 (SEQ ID NOS:1778-1792); a VH FR1 (SEQ ID NOS:570-578), a VH FR2 (SEQ ID NOS:579-602), a VH FR3 (SEQ ID NOS:603-1726), a VH FR4 (SEQ ID NOS:1727-1728), VL FR2 (SEQ ID NOS:1751-1777) and a VL FR4 (SEQ ID NOS:1793-1794); a VH FR1 (SEQ ID NOS:570-578), a VH FR2 (SEQ ID NOS:579-602), a VH FR3 (SEQ ID NOS:603-1726), a VH FR4 (SEQ ID NOS:1727-1728), VL FR3 (SEQ ID NOS:1778-1792) and a VL FR4 (SEQ ID NOS:1793-1794); a VH FR1 (SEQ ID NOS:570-578), a VH FR2 (SEQ ID NOS:579-602), a VH FR3 (SEQ ID NOS:603-1726), a VL FR1 (SEQ ID NOS:1729-1750), VL FR2 (SEQ ID NOS:1751-1777) and a VL FR3 (SEQ ID NOS:1778-1792); a VH FR1 (SEQ ID NOS:570-578), a VH FR2 (SEQ ID NOS:579-602), a VH FR3 (SEQ ID NOS:603-1726), a VL FR1 (SEQ ID NOS:1729-1750), VL FR2 (SEQ ID NOS:1751-1777) and a VL FR4 (SEQ ID NOS:1793-1794); a VH FR1 (SEQ ID NOS:570-578), a VH FR2 (SEQ ID NOS:579-602), a VH FR3 (SEQ ID NOS:603-1726), a VL FR2 (SEQ ID NOS:1751-1777), VL FR3 (SEQ ID NOS:1778-1792) and a VL FR4 (SEQ ID NOS:1793-1794); a VH FR1 (SEQ ID NOS:570-578), a VH FR2 (SEQ ID NOS:579-602), a VH FR4 (SEQ ID NOS:1727-1728), a VL FR1 (SEQ ID NOS:1729-1750), VL FR2 (SEQ ID NOS:1751-1777) and a VL FR3 (SEQ ID NOS:1778-1792); a VH FR1 (SEQ ID NOS:570-578), a VH FR2 (SEQ ID NOS:579-602), a VH FR4 (SEQ ID NOS:1727-1728), a VL FR1 (SEQ ID NOS:1729-1750), VL FR2 (SEQ ID NOS:1751-1777) and a VL FR4 (SEQ ID NOS:1793-1794); a VH FR1 (SEQ ID NOS:570-578), a VH FR2 (SEQ ID NOS:579-602), a VH FR4 (SEQ ID NOS:1727-1728), a VL FR1 (SEQ ID NOS:1729-1750), VL FR3 (SEQ ID NOS:1778-1792) and a VL FR4 (SEQ ID NOS:1793-1794); a VH FR1 (SEQ ID NOS:570-578), a VH FR2 (SEQ ID NOS:579-602), a VH FR4 (SEQ ID NOS:1727-1728), a VL FR2 (SEQ ID NOS:1751-1777), VL FR3 (SEQ ID NOS:1778-1792) and a VL FR4 (SEQ ID NOS:1793-1794); a VH FR1 (SEQ ID NOS:570-578), a VH FR3 (SEQ ID NOS:603-1726), a VH FR4 (SEQ ID NOS:1727-1728), a VL FR1 (SEQ ID NOS:1729-1750), VL FR2 (SEQ ID NOS:1751-1777) and a VL FR3 (SEQ ID NOS:1778-1792); a VH FR1 (SEQ ID NOS:570-578), a VH FR3 (SEQ ID NOS:603-1726), a VH FR4 (SEQ ID NOS:1727-1728), a VL FR1 (SEQ ID NOS:1729-1750), VL FR2 (SEQ ID NOS:1751-1777) and a VL FR4 (SEQ ID NOS:1793-1794); a VH FR1 (SEQ ID NOS:570-578), a VH FR3 (SEQ ID NOS:603-1726), a VH FR4 (SEQ ID NOS:1727-1728), a VL FR1 (SEQ ID NOS:1729-1750), VL FR3 (SEQ ID NOS:1778-1792) and a VL FR4 (SEQ ID NOS:1793-1794); a VH FR1 (SEQ ID NOS:570-578), a VH FR3 (SEQ ID NOS:603-1726), a VH FR4 (SEQ ID NOS:1727-1728), a VL FR2 (SEQ ID NOS:1751-1777), VL FR3 (SEQ ID NOS:1778-1792) and a VL FR4 (SEQ ID NOS:1793-1794); a VH FR2 (SEQ ID NOS:579-602), a VH FR3 (SEQ ID NOS:603-1726), a VH FR4 (SEQ ID NOS:1727-1728), a VL FR1 (SEQ ID NOS:1729-1750), VL FR2 (SEQ ID NOS:1751-1777) and a VL FR3 (SEQ ID NOS:1778-1792); a VH FR2 (SEQ ID NOS:579-602), a VH FR3 (SEQ ID NOS:603-1726), a VH FR4 (SEQ ID NOS:1727-1728), a VL FR1 (SEQ ID NOS:1729-1750), VL FR2 (SEQ ID NOS:1751-1777) and a VL FR4 (SEQ ID NOS:1793-1794); a VH FR2 (SEQ ID NOS:579-602), a VH FR3 (SEQ ID NOS:603-1726), a VH FR4 (SEQ ID NOS:1727-1728), a VL FR1 (SEQ ID NOS:1729-1750), VL FR3 (SEQ ID NOS:1778-1792) and a VL FR4 (SEQ ID NOS:1793-1794); a VH FR2 (SEQ ID NOS:579-602), a VH FR3 (SEQ ID NOS:603-1726), a VH FR4 (SEQ ID NOS:1727-1728), a VL FR2 (SEQ ID NOS:1751-1777), VL FR3 (SEQ ID NOS:1778-1792) and a VL FR4 (SEQ ID NOS:1793-1794); a VH FR1 (SEQ ID NOS:570-578), a VH FR2 (SEQ ID NOS:579-602), a VL FR1 (SEQ ID NOS:1729-1750), a VL FR2 (SEQ ID NOS:1751-1777), VL FR3 (SEQ ID NOS:1778-1792) and a VL FR4 (SEQ ID NOS:1793-1794); a VH FR1 (SEQ ID NOS:570-578), a VH FR3 (SEQ ID NOS:603-1726), a VL FR1 (SEQ ID NOS:1729-1750), a VL FR2 (SEQ ID NOS:1751-1777), VL FR3 (SEQ ID NOS:1778-1792) and a VL FR4 (SEQ ID NOS:1793-1794); a VH FR1 (SEQ ID NOS:570-578), a VH FR4 (SEQ ID NOS:1727-1728), a VL FR1 (SEQ ID NOS:1729-1750), a VL FR2 (SEQ ID NOS: 1751-1777), VL FR3 (SEQ ID NOS:1778-1792) and a VL FR4 (SEQ ID NOS:1793-1794); a VH FR2 (SEQ ID NOS: 579-602), a VH FR3 (SEQ ID NOS:603-1726), a VL FR1 (SEQ ID NOS:1729-1750), a VL FR2 (SEQ ID NOS:1751-1777), VL FR3 (SEQ ID NOS:1778-1792) and a VL FR4 (SEQ ID NOS:1793-1794); a VH FR2 (SEQ ID NOS:579-602), a VH FR4 (SEQ ID NOS:1727-1728), a VL FR1 (SEQ ID NOS:1729-1750), a VL FR2 (SEQ ID NOS:1751-1777), VL FR3 (SEQ ID NOS:1778-1792) and a VL FR4 (SEQ ID NOS:1793-1794); a VH FR3 (SEQ ID NOS:603-1726), a VH FR4 (SEQ ID NOS:1727-1728), a VL FR1 (SEQ ID NOS:1729-1750), a VL FR2 (SEQ ID NOS:1751-1777), VL FR3 (SEQ ID NOS:1778-1792) and a VL FR4 (SEQ ID NOS:1793-1794); a VH FR1 (SEQ ID NOS:570-578), a VH FR2 (SEQ ID NOS:579-602), a VH FR3 (SEQ ID NOS:603-1726), a VH FR4 (SEQ ID NOS:1727-1728), VL FR1 (SEQ ID NOS:1729-1750), VL FR2 (SEQ ID NOS:1751-1777) and a VL FR3 (SEQ ID NOS:1778-1792); a VH FR1 (SEQ ID NOS:570-578), a VH FR2 (SEQ ID NOS:579-602), a VH FR3 (SEQ ID NOS:603-1726), a VH FR4 (SEQ ID NOS:1727-1728), VL FR1 (SEQ ID NOS:1729-1750), VL FR2 (SEQ ID NOS:1751-1777) and a VL FR4 (SEQ ID NOS:1793-1794); a VH FR1 (SEQ ID NOS:570-578), a VH FR2 (SEQ ID NOS:579-602), a VH FR3 (SEQ ID NOS: 603-1726), a VH FR4 (SEQ ID NOS:1727-1728), VL FR2 (SEQ ID NOS:1751-1777), VL FR3 (SEQ ID NOS:1778-1792) and a VL FR4 (SEQ ID NOS:1793-1794); a VH FR1 (SEQ ID NOS:570-578), a VH FR2 (SEQ ID NOS:579-602), a VH FR3 (SEQ ID NOS:603-1726), a VL FR1 (SEQ ID NOS:1729-1750), VL FR2 (SEQ ID NOS:1751-1777), VL FR3 (SEQ ID NOS:1778-1792) and a VL FR4 (SEQ ID NOS:1793-1794); a VH FR1 (SEQ ID NOS:570-578), a VH FR2 (SEQ ID NOS:579-602), a VH FR4 (SEQ ID NOS: 1727-1728), a VL FR1 (SEQ ID NOS:1729-1750), VL FR2 (SEQ ID NOS:1751-1777), VL FR3 (SEQ ID NOS:1778-1792) and a VL FR4 (SEQ ID NOS:1793-1794); a VH FR1 (SEQ ID NOS:570-578), a VH FR2 (SEQ ID NOS:579-602), a VH FR3 (SEQ ID NOS:603-1726), a VH FR4 (SEQ ID NOS:1727-1728), a VL FR1 (SEQ ID NOS:1729-1750), VL FR2 (SEQ ID NOS:1751-1777), VL FR3 (SEQ ID NOS:1778-1792) and a VL FR4 (SEQ ID NOS:1793-1794); or any combination thereof of the VH FRs (SEQ ID NOS: 478-1636) and VL FRs (SEQ ID NOS: 1637-1702) listed in Tables 25.

In yet another aspect, antibodies are provided that compete with one of the exemplified antibodies or functional fragments for binding to GFRAL. Such antibodies may also bind to the same epitope as one of the herein exemplified antibodies, or an overlapping epitope. Antibodies and fragments that compete with or bind to the same epitope as the exemplified antibodies are expected to show similar functional properties. The exemplified antigen binding proteins and fragments include those with the VH and VL regions, and CDRs provided herein, including those in Tables 1-24. Thus, as a specific example, the antibodies that are provided include those that compete with an antibody comprising: (a) 1, 2, 3, 4, 5 or all 6 of the CDRs listed for an antibody listed in Tables 1-24; (b) a VH and a VL selected from the VH and a VL regions listed for an antibody listed in Tables 1-24; or (c) two light chains and two heavy chains comprising a VH and a VL as specified for an antibody listed in Tables 1-24.

In certain embodiments, antibodies of the compositions and methods of using the antibodies provided herein include those anti-GFRAL monoclonal antibodies described herein, e.g., in the Examples section. Any anti-GFRAL antibody can be used in any of the methods provided herein. In some embodiments of the various methods provided herein, the antibody comprises a VH region comprising the amino acid sequence of SEQ ID NO: 1, or a humanized variant thereof. In some embodiments of the various methods provided herein, the antibody comprises a VH region comprising the amino acid sequence of SEQ ID NO: 3, or a humanized variant thereof. In some embodiments of the various methods provided herein, the antibody comprises a VH region comprising the amino acid sequence of SEQ ID NO: 5, or a humanized variant thereof. In some embodiments of the various methods provided herein, the antibody comprises a VH region comprising the amino acid sequence of SEQ ID NO: 7, or a humanized variant thereof. In some embodiments of the various methods provided herein, the antibody comprises a VH region comprising the amino acid sequence of SEQ ID NO: 9, or a humanized variant thereof. In some embodiments of the various methods provided herein, the antibody comprises a VH region comprising the amino acid sequence of SEQ ID NO: 11, or a humanized variant thereof. In some embodiments of the various methods provided herein, the antibody comprises a VH region comprising the amino acid sequence of SEQ ID NO: 13, or a humanized variant thereof. In some embodiments of the various methods provided herein, the antibody comprises a VH region comprising the amino acid sequence of SEQ ID NO: 15, or a humanized variant thereof. In some embodiments of the various methods provided herein, the antibody comprises a VH region comprising the amino acid sequence of SEQ ID NO: 17, or a humanized variant thereof. In some embodiments of the various methods provided herein, the antibody comprises a VH region comprising the amino acid sequence of SEQ ID NO: 17, or a humanized variant thereof. In some embodiments of the various methods provided herein, the antibody comprises a VH region comprising the amino acid sequence of SEQ ID NO: 19, or a humanized variant thereof. In some embodiments of the various methods provided herein, the antibody comprises a VH region comprising the amino acid sequence of SEQ ID NO: 21, or a humanized variant thereof. In some embodiments of the various methods provided herein, the antibody comprises a VH region comprising the amino acid sequence of SEQ ID NO: 23, or a humanized variant thereof. In some embodiments of the various methods provided herein, the antibody comprises a VH region comprising the amino acid sequence of SEQ ID NO: 25, or a humanized variant thereof. In some embodiments of the various methods provided herein, the antibody comprises a VH region comprising the amino acid sequence of SEQ ID NO: 27, or a humanized variant thereof. In some embodiments of the various methods provided herein, the antibody comprises a VH region comprising the amino acid sequence of SEQ ID NO: 29, or a humanized variant thereof. In some embodiments of the various methods provided herein, the antibody comprises a VH region comprising the amino acid sequence of SEQ ID NO: 31, or a humanized variant thereof. In some embodiments of the various methods provided herein, the antibody comprises a VH region comprising the amino acid sequence of SEQ ID NO: 33, or a humanized variant thereof. In some embodiments of the various methods provided herein, the antibody comprises a VH region comprising the amino acid sequence of SEQ ID NO: 35, or a humanized variant thereof. In some embodiments of the various methods provided herein, the antibody comprises a VH region comprising the amino acid sequence of SEQ ID NO: 37, or a humanized variant thereof. In some embodiments of the various methods provided herein, the antibody comprises a VH region comprising the amino acid sequence of SEQ ID NO: 39, or a humanized variant thereof. In some embodiments of the various methods provided herein, the antibody comprises a VH region comprising the amino acid sequence of SEQ ID NO: 480, or a humanized variant thereof. In some embodiments of the various methods provided herein, the antibody comprises a VH region comprising the amino acid sequence of SEQ ID NO: 482, or a humanized variant thereof. In some embodiments of the various methods provided herein, the antibody comprises a VH region comprising the amino acid sequence of SEQ ID NO: 484, or a humanized variant thereof. In some embodiments of the various methods provided herein, the antibody comprises a VH region comprising the amino acid sequence of SEQ ID NO: 486, or a humanized variant thereof.

In some embodiments of the various methods provided herein, the antibody comprises a VL region comprising the amino acid sequence of SEQ ID NO: 2, or a humanized variant thereof. In some embodiments of the various methods provided herein, the antibody comprises a VL region comprising the amino acid sequence of SEQ ID NO: 4, or a humanized variant thereof. In some embodiments of the various methods provided herein, the antibody comprises a VL region comprising the amino acid sequence of SEQ ID NO: 6, or a humanized variant thereof. In some embodiments of the various methods provided herein, the antibody comprises a VL region comprising the amino acid sequence of SEQ ID NO: 8, or a humanized variant thereof. In some embodiments of the various methods provided herein, the antibody comprises a VL region comprising the amino acid sequence of SEQ ID NO: 10, or a humanized variant thereof. In some embodiments of the various methods provided herein, the antibody comprises a VL region comprising the amino acid sequence of SEQ ID NO: 12, or a humanized variant thereof. In some embodiments of the various methods provided herein, the antibody comprises a VL region comprising the amino acid sequence of SEQ ID NO: 14, or a humanized variant thereof. In some embodiments of the various methods provided herein, the antibody comprises a VL region comprising the amino acid sequence of SEQ ID NO: 16, or a humanized variant thereof. In some embodiments of the various methods provided herein, the antibody comprises a VL region comprising the amino acid sequence of SEQ ID NO: 18, or a humanized variant thereof. In some embodiments of the various methods provided herein, the antibody comprises a VL region comprising the amino acid sequence of SEQ ID NO: 20, or a humanized variant thereof. In some embodiments of the various methods provided herein, the antibody comprises a VL region comprising the amino acid sequence of SEQ ID NO: 22, or a humanized variant thereof. In some embodiments of the various methods provided herein, the antibody comprises a VL region comprising the amino acid sequence of SEQ ID NO: 24, or a humanized variant thereof. In some embodiments of the various methods provided herein, the antibody comprises a VL region comprising the amino acid sequence of SEQ ID NO: 26, or a humanized variant thereof. In some embodiments of the various methods provided herein, the antibody comprises a VL region comprising the amino acid sequence of SEQ ID NO: 28, or a humanized variant thereof. In some embodiments of the various methods provided herein, the antibody comprises a VL region comprising the amino acid sequence of SEQ ID NO: 30, or a humanized variant thereof. In some embodiments of the various methods provided herein, the antibody comprises a VL region comprising the amino acid sequence of SEQ ID NO: 32, or a humanized variant thereof. In some embodiments of the various methods provided herein, the antibody comprises a VL region comprising the amino acid sequence of SEQ ID NO: 34, or a humanized variant thereof. In some embodiments of the various methods provided herein, the antibody comprises a VL region comprising the amino acid sequence of SEQ ID NO: 36, or a humanized variant thereof. In some embodiments of the various methods provided herein, the antibody comprises a VL region comprising the amino acid sequence of SEQ ID NO: 38, or a humanized variant thereof. In some embodiments of the various methods provided herein, the antibody comprises a VL region comprising the amino acid sequence of SEQ ID NO: 40, or a humanized variant thereof.

In some embodiments of the various methods provided herein, the antibody comprises a VL region comprising the amino acid sequence of SEQ ID NO: 481, or a humanized variant thereof. In some embodiments of the various methods provided herein, the antibody comprises a VL region comprising the amino acid sequence of SEQ ID NO: 483, or a humanized variant thereof. In some embodiments of the various methods provided herein, the antibody comprises a VL region comprising the amino acid sequence of SEQ ID NO: 485, or a humanized variant thereof. In some embodiments of the various methods provided herein, the antibody comprises a VL region comprising the amino acid sequence of SEQ ID NO: 487, or a humanized variant thereof.

In some embodiments of the various methods provided herein, the antibody comprises a VH region comprising the amino acid sequence of SEQ ID NO: 1, or a humanized variant thereof, and a VL region comprising the amino acid sequence of SEQ ID NO: 2, or a humanized variant thereof. In some embodiments of the various methods provided herein, the antibody comprises a VH region comprising the amino acid sequence of SEQ ID NO: 3, or a humanized variant thereof, and a VL region comprising the amino acid sequence of SEQ ID NO: 4, or a humanized variant thereof. In some embodiments of the various methods provided herein, the antibody comprises a VH region comprising the amino acid sequence of SEQ ID NO: 5, or a humanized variant thereof, and a VL region comprising the amino acid sequence of SEQ ID NO: 6, or a humanized variant thereof. In some embodiments of the various methods provided herein, the antibody comprises a VH region comprising the amino acid sequence of SEQ ID NO: 7, or a humanized variant thereof, and a VL region comprising the amino acid sequence of SEQ ID NO: 8, or a humanized variant thereof. In some embodiments of the various methods provided herein, the antibody comprises a VH region comprising the amino acid sequence of SEQ ID NO: 9, or a humanized variant thereof, and a VL region comprising the amino acid sequence of SEQ ID NO: 10, or a humanized variant thereof. In some embodiments of the various methods provided herein, the antibody comprises a VH region comprising the amino acid sequence of SEQ ID NO: 11, or a humanized variant thereof, and a VL region comprising the amino acid sequence of SEQ ID NO: 12, or a humanized variant thereof. In some embodiments of the various methods provided herein, the antibody comprises a VH region comprising the amino acid sequence of SEQ ID NO: 13, or a humanized variant thereof, and a VL region comprising the amino acid sequence of SEQ ID NO: 14, or a humanized variant thereof. In some embodiments of the various methods provided herein, the antibody comprises a VH region comprising the amino acid sequence of SEQ ID NO: 15, or a humanized variant thereof, and a VL region comprising the amino acid sequence of SEQ ID NO: 16, or a humanized variant thereof. In some embodiments of the various methods provided herein, the antibody comprises a VH region comprising the amino acid sequence of SEQ ID NO: 17, or a humanized variant thereof, and a VL region comprising the amino acid sequence of SEQ ID NO: 18, or a humanized variant thereof. In some embodiments of the various methods provided herein, the antibody comprises a VH region comprising the amino acid sequence of SEQ ID NO: 19, or a humanized variant thereof, and a VL region comprising the amino acid sequence of SEQ ID NO: 20, or a humanized variant thereof. In some embodiments of the various methods provided herein, the antibody comprises a VH region comprising the amino acid sequence of SEQ ID NO: 21, or a humanized variant thereof, and a VL region comprising the amino acid sequence of SEQ ID NO: 22, or a humanized variant thereof. In some embodiments of the various methods provided herein, the antibody comprises a VH region comprising the amino acid sequence of SEQ ID NO: 23, or a humanized variant thereof, and a VL region comprising the amino acid sequence of SEQ ID NO: 24, or a humanized variant thereof. In some embodiments of the various methods provided herein, the antibody comprises a VH region comprising the amino acid sequence of SEQ ID NO: 25, or a humanized variant thereof, and a VL region comprising the amino acid sequence of SEQ ID NO: 26, or a humanized variant thereof. In some embodiments of the various methods provided herein, the antibody comprises a VH region comprising the amino acid sequence of SEQ ID NO: 27, or a humanized variant thereof, and a VL region comprising the amino acid sequence of SEQ ID NO: 28, or a humanized variant thereof. In some embodiments of the various methods provided herein, the antibody comprises a VH region comprising the amino acid sequence of SEQ ID NO: 29, or a humanized variant thereof, and a VL region comprising the amino acid sequence of SEQ ID NO: 30, or a humanized variant thereof. In some embodiments of the various methods provided herein, the antibody comprises a VH region comprising the amino acid sequence of SEQ ID NO: 31, or a humanized variant thereof, and a VL region comprising the amino acid sequence of SEQ ID NO: 32, or a humanized variant thereof. In some embodiments of the various methods provided herein, the antibody comprises a VH region comprising the amino acid sequence of SEQ ID NO: 33, or a humanized variant thereof, and a VL region comprising the amino acid sequence of SEQ ID NO: 34, or a humanized variant thereof. In some embodiments of the various methods provided herein, the antibody comprises a VH region comprising the amino acid sequence of SEQ ID NO: 35, or a humanized variant thereof, and a VL region comprising the amino acid sequence of SEQ ID NO: 36, or a humanized variant thereof. In some embodiments of the various methods provided herein, the antibody comprises a VH region comprising the amino acid sequence of SEQ ID NO: 37, or a humanized variant thereof, and a VL region comprising the amino acid sequence of SEQ ID NO: 38, or a humanized variant thereof. In some embodiments of the various methods provided herein, the antibody comprises a VH region comprising the amino acid sequence of SEQ ID NO: 39, or a humanized variant thereof, and a VL region comprising the amino acid sequence of SEQ ID NO: 40, or a humanized variant thereof. In some embodiments of the various methods provided herein, the antibody comprises a VH region comprising the amino acid sequence of SEQ ID NO: 480, or a humanized variant thereof, and a VL region comprising the amino acid sequence of SEQ ID NO: 481, or a humanized variant thereof. In some embodiments of the various methods provided herein, the antibody comprises a VH region comprising the amino acid sequence of SEQ ID NO: 482, or a humanized variant thereof, and a VL region comprising the amino acid sequence of SEQ ID NO: 483, or a humanized variant thereof. In some embodiments of the various methods provided herein, the antibody comprises a VH region comprising the amino acid sequence of SEQ ID NO: 484, or a humanized variant thereof, and a VL region comprising the amino acid sequence of SEQ ID NO: 485, or a humanized variant thereof. In some embodiments of the various methods provided herein, the antibody comprises a VH region comprising the amino acid sequence of SEQ ID NO: 486, or a humanized variant thereof, and a VL region comprising the amino acid sequence of SEQ ID NO: 487, or a humanized variant thereof.

In some embodiments of the various methods provided herein, the antibody comprises a VH CDR1, VH CDR2, and VH CDR3 of a VH domain having the amino acid sequence of SEQ ID NO: 1 and a VL CDR1, VL CDR2, and VL CDR3 of a VL region comprising the amino acid sequence of SEQ ID NO: 2. In some embodiments of the various methods provided herein, the antibody comprises a VH CDR1, VH CDR2, and VH CDR3 of a VH domain having the amino acid sequence of SEQ ID NO: 3 and a VL CDR1, VL CDR2, and VL CDR3 of a VL region comprising the amino acid sequence of SEQ ID NO: 4. In some embodiments of the various methods provided herein, the antibody comprises a VH CDR1, VH CDR2, and VH CDR3 of a VH domain having the amino acid sequence of SEQ ID NO: 5 and a VL CDR1, VL CDR2, and VL CDR3 of a VL region comprising the amino acid sequence of SEQ ID NO: 6. In some embodiments of the various methods provided herein, the antibody comprises a VH CDR1, VH CDR2, and VH CDR3 of a VH domain having the amino acid sequence of SEQ ID NO: 7 and a VL CDR1, VL CDR2, and VL CDR3 of a VL region comprising the amino acid sequence of SEQ ID NO: 8. In some embodiments of the various methods provided herein, the antibody comprises a VH CDR1, VH CDR2, and VH CDR3 of a VH domain having the amino acid sequence of SEQ ID NO: 9 and a VL CDR1, VL CDR2, and VL CDR3 of a VL region comprising the amino acid sequence of SEQ ID NO: 10. In some embodiments of the various methods provided herein, the antibody comprises a VH CDR1, VH CDR2, and VH CDR3 of a VH domain having the amino acid sequence of SEQ ID NO: 11 and a VL CDR1, VL CDR2, and VL CDR3 of a VL region comprising the amino acid sequence of SEQ ID NO: 12. In some embodiments of the various methods provided herein, the antibody comprises a VH CDR1, VH CDR2, and VH CDR3 of a VH domain having the amino acid sequence of SEQ ID NO: 13 and a VL CDR1, VL CDR2, and VL CDR3 of a VL region comprising the amino acid sequence of SEQ ID NO: 14. In some embodiments of the various methods provided herein, the antibody comprises a VH CDR1, VH CDR2, and VH CDR3 of a VH domain having the amino acid sequence of SEQ ID NO: 15 and a VL CDR1, VL CDR2, and VL CDR3 of a VL region comprising the amino acid sequence of SEQ ID NO: 16. In some embodiments of the various methods provided herein, the antibody comprises a VH CDR1, VH CDR2, and VH CDR3 of a VH domain having the amino acid sequence of SEQ ID NO: 17 and a VL CDR1, VL CDR2, and VL CDR3 of a VL region comprising the amino acid sequence of SEQ ID NO: 18. In some embodiments of the various methods provided herein, the antibody comprises a VH CDR1, VH CDR2, and VH CDR3 of a VH domain having the amino acid sequence of SEQ ID NO: 19 and a VL CDR1, VL CDR2, and VL CDR3 of a VL region comprising the amino acid sequence of SEQ ID NO: 20. In some embodiments of the various methods provided herein, the antibody comprises a VH CDR1, VH CDR2, and VH CDR3 of a VH domain having the amino acid sequence of SEQ ID NO: 21 and a VL CDR1, VL CDR2, and VL CDR3 of a VL region comprising the amino acid sequence of SEQ ID NO: 22. In some embodiments of the various methods provided herein, the antibody comprises a VH CDR1, VH CDR2, and VH CDR3 of a VH domain having the amino acid sequence of SEQ ID NO: 23 and a VL CDR1, VL CDR2, and VL CDR3 of a VL region comprising the amino acid sequence of SEQ ID NO: 24. In some embodiments of the various methods provided herein, the antibody comprises a VH CDR1, VH CDR2, and VH CDR3 of a VH domain having the amino acid sequence of SEQ ID NO: 25 and a VL CDR1, VL CDR2, and VL CDR3 of a VL region comprising the amino acid sequence of SEQ ID NO: 26. In some embodiments of the various methods provided herein, the antibody comprises a VH CDR1, VH CDR2, and VH CDR3 of a VH domain having the amino acid sequence of SEQ ID NO: 27 and a VL CDR1, VL CDR2, and VL CDR3 of a VL region comprising the amino acid sequence of SEQ ID NO: 28. In some embodiments of the various methods provided herein, the antibody comprises a VH CDR1, VH CDR2, and VH CDR3 of a VH domain having the amino acid sequence of SEQ ID NO: 29 and a VL CDR1, VL CDR2, and VL CDR3 of a VL region comprising the amino acid sequence of SEQ ID NO: 30. In some embodiments of the various methods provided herein, the antibody comprises a VH CDR1, VH CDR2, and VH CDR3 of a VH domain having the amino acid sequence of SEQ ID NO: 31 and a VL CDR1, VL CDR2, and VL CDR3 of a VL region comprising the amino acid sequence of SEQ ID NO: 32. In some embodiments of the various methods provided herein, the antibody comprises a VH CDR1, VH CDR2, and VH CDR3 of a VH domain having the amino acid sequence of SEQ ID NO: 33 and a VL CDR1, VL CDR2, and VL CDR3 of a VL region comprising the amino acid sequence of SEQ ID NO: 34. In some embodiments of the various methods provided herein, the antibody comprises a VH CDR1, VH CDR2, and VH CDR3 of a VH domain having the amino acid sequence of SEQ ID NO: 35 and a VL CDR1, VL CDR2, and VL CDR3 of a VL region comprising the amino acid sequence of SEQ ID NO: 36. In some embodiments of the various methods provided herein, the antibody comprises a VH CDR1, VH CDR2, and VH CDR3 of a VH domain having the amino acid sequence of SEQ ID NO: 37 and a VL CDR1, VL CDR2, and VL CDR3 of a VL region comprising the amino acid sequence of SEQ ID NO: 38. In some embodiments of the various methods provided herein, the antibody comprises a VH CDR1, VH CDR2, and VH CDR3 of a VH domain having the amino acid sequence of SEQ ID NO: 39 and a VL CDR1, VL CDR2, and VL CDR3 of a VL region comprising the amino acid sequence of SEQ ID NO: 40. In some embodiments of the various methods provided herein, the antibody comprises a VH CDR1, VH CDR2, and VH CDR3 of a VH domain having the amino acid sequence of SEQ ID NO: 480 and a VL CDR1, VL CDR2, and VL CDR3 of a VL region comprising the amino acid sequence of SEQ ID NO: 481. In some embodiments of the various methods provided herein, the antibody comprises a VH CDR1, VH CDR2, and VH CDR3 of a VH domain having the amino acid sequence of SEQ ID NO: 482 and a VL CDR1, VL CDR2, and VL CDR3 of a VL region comprising the amino acid sequence of SEQ ID NO: 483. In some embodiments of the various methods provided herein, the antibody comprises a VH CDR1, VH CDR2, and VH CDR3 of a VH domain having the amino acid sequence of SEQ ID NO: 484 and a VL CDR1, VL CDR2, and VL CDR3 of a VL region comprising the amino acid sequence of SEQ ID NO: 485. In some embodiments of the various methods provided herein, the antibody comprises a VH CDR1, VH CDR2, and VH CDR3 of a VH domain having the amino acid sequence of SEQ ID NO: 486 and a VL CDR1, VL CDR2, and VL CDR3 of a VL region comprising the amino acid sequence of SEQ ID NO: 487. Other VH domain, VL domain, VH CDR1, VH CDR2, VH CDR3, VL CDR1, VL CDR2 and VL CDR3 sequences listed described herein are also contemplated for use in the various methods provided herein.

1. Polyclonal Antibodies

The antibodies of the present disclosure may comprise polyclonal antibodies. Methods of preparing polyclonal antibodies are known to the skilled artisan. Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. The immunizing agent may include a GFRAL polypeptide or a fusion protein thereof. It may be useful to conjugate the immunizing agent to a protein known to be immunogenic in the mammal being immunized or to immunize the mammal with the protein and one or more adjuvants. Examples of such immunogenic proteins include but are not limited to keyhole limpet hemocyanin, serum albumin, bovine thyroglobulin, and soybean trypsin inhibitor. Examples of adjuvants which may be employed include Ribi, CpG, Poly 1C, Freund's complete adjuvant and MPL-TDM adjuvant (monophosphoryl Lipid A, synthetic trehalose dicorynomycolate). The immunization protocol may be selected by one skilled in the art without undue experimentation. The mammal can then be bled, and the serum assayed for GFRAL antibody titer. If desired, the mammal can be boosted until the antibody titer increases or plateaus. Additionally or alternatively, lymphocytes may be obtained from the immunized animal for fusion and the preparation of monoclonal antibodies from hybridoma as described below.

2. Monoclonal Antibodies

The antibodies of the present disclosure may alternatively be monoclonal antibodies. Monoclonal antibodies may be made using the hybridoma method first described by Kohler et al., Nature, 256:495 (1975), or may be made by recombinant DNA methods (see, e.g., U.S. Pat. No. 4,816,567).

In the hybridoma method, a mouse or other appropriate host animal, such as a hamster, is immunized as described above to elicit lymphocytes that produce or are capable of producing antibodies that will specifically bind to the protein used for immunization. Alternatively, lymphocytes may be immunized in vitro. After immunization, lymphocytes are isolated and then fused with a myeloma cell line using a suitable fusing agent, such as polyethylene glycol, to form a hybridoma cell (Goding, Monoclonal Antibodies: Principles and Practice, pp. 59-103 (Academic Press, 1986)).

The hybridoma cells thus prepared are seeded and grown in a suitable culture medium which medium preferably contains one or more substances that inhibit the growth or survival of the unfused, parental myeloma cells (also referred to as fusion partner). For example, if the parental myeloma cells lack the enzyme hypoxanthine guanine phosphoribosyl transferase (HGPRT or HPRT), the selective culture medium for the hybridomas typically will include hypoxanthine, aminopterin, and thymidine (HAT medium), which substances prevent the growth of HGPRT-deficient cells.

Preferred fusion partner myeloma cells are those that fuse efficiently, support stable high-level production of antibody by the selected antibody-producing cells, and are sensitive to a selective medium that selects against the unfused parental cells. Preferred myeloma cell lines are murine myeloma lines, such as SP-2 and derivatives, for example, X63-Ag8-653 cells available from the American Type Culture Collection, Manassas, Va., USA and those derived from MOPC-21 and MPC-11 mouse tumors available from the Salk Institute Cell Distribution Center, San Diego, Calif. USA. Human myeloma and mouse-human heteromyeloma cell lines also have been described for the production of human monoclonal antibodies (Kozbor, J., *Immunol.*, 133:3001 (1984); and Brodeur et al., *Monoclonal Antibody Production Techniques and Applications*, pp. 51-63 (Marcel Dekker, Inc., New York, 1987)).

Culture medium in which hybridoma cells are growing is assayed for production of monoclonal antibodies directed against the antigen. The binding specificity of monoclonal antibodies produced by hybridoma cells is determined by immunoprecipitation or by an in vitro binding assay, such as radioimmunoassay (RIA) or enzyme-linked immunosorbent assay (ELISA). The binding affinity of the monoclonal antibody can, for example, be determined by the Scatchard analysis described in Munson et al., *Anal. Biochem.*, 107: 220 (1980).

Once hybridoma cells that produce antibodies of the desired specificity, affinity, and/or activity are identified, the clones may be subcloned by limiting dilution procedures and grown by standard methods (Goding, *Monoclonal Antibodies: Principles and Practice*, pp. 59-103 (Academic Press, 1986)). Suitable culture media for this purpose include, for example, D-MEM or RPMI-1640 medium. In addition, the hybridoma cells may be grown in vivo as ascites tumors in an animal, for example, by i.p. injection of the cells into mice.

The monoclonal antibodies secreted by the subclones are suitably separated from the culture medium, ascites fluid, or serum by conventional antibody purification procedures such as, for example, affinity chromatography (e.g., using protein A or protein G-Sepharose) or ion-exchange chromatography, hydroxylapatite chromatography, gel electrophoresis, dialysis, etc.

DNA encoding the monoclonal antibodies is readily isolated and sequenced using conventional procedures (e.g., by using oligonucleotide probes that are capable of binding specifically to genes encoding the heavy and light chains of murine antibodies). The hybridoma cells serve as a preferred source of such DNA. Once isolated, the DNA may be placed into expression vectors, which are then transfected into host cells such as *E. coli* cells, simian COS cells, Chinese Hamster Ovary (CHO) cells, or myeloma cells that do not otherwise produce antibody protein, to obtain the synthesis of monoclonal antibodies in the recombinant host cells. Review articles on recombinant expression in bacteria of DNA encoding the antibody include Skerra et al., *Curr. Opinion in Immunol.*, 5:256-262 (1993) and Plückthun, *Immunol. Revs.* 130:151-188 (1992).

In some embodiments, an antibody that binds a GFRAL epitope comprises an amino acid sequence of a VH domain and/or an amino acid sequence of a VL domain encoded by a nucleotide sequence that hybridizes to (1) the complement of a nucleotide sequence encoding any one of the VH and/or VL domain described herein under stringent conditions (e.g., hybridization to filter-bound DNA in 6× sodium chloride/sodium citrate (SSC) at about 45° C. followed by one or more washes in 0.2×SSC/0.1% SDS at about 50-65° C.) under highly stringent conditions (e.g., hybridization to filter-bound nucleic acid in 6×SSC at about 45° C. followed by one or more washes in 0.1×SSC/0.2% SDS at about 68° C.), or under other stringent hybridization conditions which are known to those of skill in the art (see, for example, Ausubel, F. M. et al., eds., 1989, *Current Protocols in Molecular Biology*, Vol. I, Green Publishing Associates, Inc. and John Wiley & Sons, Inc., New York at pages 6.3.1-6.3.6 and 2.10.3).

In some embodiments, an antibody that binds a GFRAL epitope comprises an amino acid sequence of a VH CDR or an amino acid sequence of a VL CDR encoded by a nucleotide sequence that hybridizes to the complement of a nucleotide sequence encoding any one of the VH CDRs and/or VL CDRs depicted in Tables 1-24 under stringent conditions (e.g., hybridization to filter-bound DNA in 6×SSC at about 45° C. followed by one or more washes in 0.2×SSC/0.1% SDS at about 50-65° C.), under highly stringent conditions (e.g., hybridization to filter-bound nucleic acid in 6×SSC at about 45° C. followed by one or more washes in 0.1×SSC/0.2% SDS at about 68° C.), or under other stringent hybridization conditions which are known to those of skill in the art (see, for example, Ausubel, F. M. et al., eds., 1989, *Current Protocols in Molecular Biology*, Vol. I, Green Publishing Associates, Inc. and John Wiley & Sons, Inc., New York at pages 6.3.1-6.3.6 and 2.10.3).

In a further embodiment, monoclonal antibodies or antibody fragments can be isolated from antibody phage libraries generated using the techniques described in, for example, *Antibody Phage Display: Methods and Protocols*, P. M. O'Brien and R. Aitken, eds, Humana Press, Totawa N.J., 2002. In principle, synthetic antibody clones are selected by screening phage libraries containing phage that display various fragments of antibody variable region (Fv) fused to phage coat protein. Such phage libraries are screened for against the desired antigen. Clones expressing Fv fragments capable of binding to the desired antigen are adsorbed to the antigen and thus separated from the non-binding clones in the library. The binding clones are then eluted from the antigen, and can be further enriched by additional cycles of antigen adsorption/elution.

Variable domains can be displayed functionally on phage, either as single-chain Fv (scFv) fragments, in which VH and VL are covalently linked through a short, flexible peptide, or as Fab fragments, in which they are each fused to a constant domain and interact non-covalently, as described, for example, in Winter et al., *Ann. Rev. Immunol.*, 12: 433-455 (1994).

Repertoires of VH and VL genes can be separately cloned by polymerase chain reaction (PCR) and recombined randomly in phage libraries, which can then be searched for antigen-binding clones as described in Winter et al., supra. Libraries from immunized sources provide high-affinity antibodies to the immunogen without the requirement of constructing hybridomas. Alternatively, the naive repertoire can be cloned to provide a single source of human antibodies to a wide range of non-self and also self antigens without any immunization as described by Griffiths et al., *EMBO J*, 12: 725-734 (1993). Finally, naive libraries can also be made synthetically by cloning the unrearranged V-gene segments from stem cells, and using PCR primers containing random sequence to encode the highly variable CDR3 regions and to accomplish rearrangement in vitro as described, for example, by Hoogenboom and Winter, *J. Mol. Biol.*, 227: 381-388 (1992).

Screening of the libraries can be accomplished by various techniques known in the art. For example, GFRAL, (e.g., a GFRAL polypeptide, fragment or epitope) can be used to coat the wells of adsorption plates, expressed on host cells affixed to adsorption plates or used in cell sorting, or conjugated to biotin for capture with streptavidin-coated beads, or used in any other method for panning display libraries. The selection of antibodies with slow dissociation kinetics (e.g., good binding affinities) can be promoted by use of long washes and monovalent phage display as described in Bass et al., *Proteins*, 8: 309-314 (1990) and in WO 92/09690, and a low coating density of antigen as described in Marks et al., *Biotechnol.*, 10: 779-783 (1992).

Anti-GFRAL antibodies can be obtained by designing a suitable antigen screening procedure to select for the phage clone of interest followed by construction of a full length anti-GFRAL antibody clone using VH and/or VL sequences (e.g., the Fv sequences), or various CDR sequences from VH and VL sequences, from the phage clone of interest and suitable constant region (e.g., Fc) sequences described in Kabat et al., *Sequences of Proteins of Immunological Interest*, Fifth Edition, NIH Publication 91-3242, Bethesda Md. (1991), vols. 1-3.

3. Antibody Fragments

The present disclosure provides antibodies and antibody fragments that bind to GFRAL. In certain circumstances there are advantages of using antibody fragments, rather than whole antibodies. The smaller size of the fragments allows for rapid clearance, and may lead to improved access to cells, tissues or organs. For a review of certain antibody fragments, see Hudson et al. (2003) *Nat. Med.* 9:129-134.

Various techniques have been developed for the production of antibody fragments. Traditionally, these fragments were derived via proteolytic digestion of intact antibodies (see, e.g., Morimoto et al., *Journal of Biochemical and Biophysical Methods* 24:107-117 (1992); and Brennan et al., *Science*, 229:81 (1985)). However, these fragments can now be produced directly by recombinant host cells. Fab, Fv and ScFv antibody fragments can all be expressed in and secreted from *E. coli* or yeast cells, thus allowing the facile production of large amounts of these fragments. Antibody fragments can be isolated from the antibody phage libraries discussed above. Alternatively, Fab'-SH fragments can be directly recovered from *E. coli* and chemically coupled to form F(ab')$_2$ fragments (Carter et al., *Bio/Technology* 10:163-167 (1992)). According to another approach, F(ab')$_2$ fragments can be isolated directly from recombinant host cell culture. Fab and F(ab')$_2$ fragment with increased in vivo half-life comprising salvage receptor binding epitope residues are described, for example, U.S. Pat. No. 5,869,046. Other techniques for the production of antibody fragments will be apparent to the skilled practitioner. In certain embodiments, an antibody is a single chain Fv fragment (scFv) (see, e.g., WO 93/16185; U.S. Pat. Nos. 5,571,894; and 5,587,458). Fv and scFv have intact combining sites that are devoid of constant regions; thus, they may be suitable for reduced nonspecific binding during in vivo use. scFv fusion proteins may be constructed to yield fusion of an effector protein at either the amino or the carboxy terminus of an scFv. (See, e.g., Antibody Engineering, ed. Borrebaeck, supra). The antibody fragment may also be a "linear antibody", for example, as described, for example, in the references cited above. Such linear antibodies may be monospecific or multi-specific, such as bispecific.

Smaller antibody-derived binding structures are the separate variable domains (V domains) also termed single variable domain antibodies (SdAbs). Certain types of organisms, the camelids and cartilaginous fish, possess high affinity single V-like domains mounted on an Fc equivalent domain structure as part of their immune system. (Woolven et al., *Immunogenetics* 50: 98-101, 1999; Streltsov et al., *Proc Natl Acad Sci USA*. 101:12444-12449, 2004). The V-like domains (called VhH in camelids and V-NAR in sharks) typically display long surface loops, which allow penetration of cavities of target antigens. They also stabilize isolated VH domains by masking hydrophobic surface patches.

These VhH and V-NAR domains have been used to engineer sdAbs. Human V domain variants have been designed using selection from phage libraries and other approaches that have resulted in stable, high binding VL- and VH-derived domains.

Antibodies that bind to GFRAL as provided herein include, but are not limited to, synthetic antibodies, monoclonal antibodies, recombinantly produced antibodies, multispecific antibodies (including bi-specific antibodies), human antibodies, humanized antibodies, camelized antibodies, chimeric antibodies, intrabodies, anti-idiotypic (anti-Id) antibodies, and functional fragments, (e.g., GFRAL binding fragments) of any of the above. Non-limiting examples of functional fragments (e.g., fragments that bind to GFRAL) include single-chain Fvs (scFv) (e.g., including monospecific, bispecific, etc.), Fab fragments, F(ab') fragments, F(ab)2 fragments, F(ab')2 fragments, disulfide-linked Fvs (sdFv), Fd fragments, Fv fragments, diabody, triabody, tetrabody and minibody.

Antibodies provided herein include, but are not limited to, immunoglobulin molecules and immunologically active portions of immunoglobulin molecules, for example, molecules that contain an antigen binding site that bind to a GFRAL epitope. The immunoglobulin molecules provided herein can be of any type (e.g., IgG, IgE, IgM, IgD, IgA and IgY), class (e.g., IgG1, IgG2, IgG3, IgG4, IgA1 and IgA2) or subclass of immunoglobulin molecule.

Variants and derivatives of antibodies include antibody functional fragments that retain the ability to bind to a GFRAL epitope. Exemplary functional fragments include Fab fragments (e.g., an antibody fragment that contains the antigen-binding domain and comprises a light chain and part of a heavy chain bridged by a disulfide bond); Fab' (e.g., an antibody fragment containing a single anti-binding domain comprising an Fab and an additional portion of the heavy chain through the hinge region); F(ab')2 (e.g., two Fab' molecules joined by interchain disulfide bonds in the hinge regions of the heavy chains; the Fab' molecules may be directed toward the same or different epitopes); a bispecific Fab (e.g., a Fab molecule having two antigen binding domains, each of which may be directed to a different epitope); a single chain Fab chain comprising a variable region, also known as, a sFv (e.g., the variable, antigen-binding determinative region of a single light and heavy chain of an antibody linked together by a chain of 10-25 amino acids); a disulfide-linked Fv, or dsFv (e.g., the variable, antigen-binding determinative region of a single light and heavy chain of an antibody linked together by a disulfide bond); a camelized VH (e.g., the variable, antigen-binding determinative region of a single heavy chain of an antibody in which some amino acids at the VH interface are those found in the heavy chain of naturally occurring camel antibodies); a bispecific sFv (e.g., a sFv or a dsFv molecule having two antigen-binding domains, each of which may be directed to a different epitope); a diabody (e.g., a dimerized sFv formed when the VH domain of a first sFv assembles with the VL domain of a second sFv and the VL domain of the first sFv assembles with the VH domain of the second sFv; the two antigen-binding regions of the diabody may be directed towards the same or different epitopes); and a triabody (e.g., a trimerized sFv, formed in a manner similar to a diabody, but in which three antigen-binding domains are created in a single complex; the three antigen binding domains may be directed towards the same or different epitopes). Derivatives of antibodies also include one or more CDR sequences of an antibody combining site. The CDR sequences may be linked together on a scaffold when two or more CDR sequences are present. In certain embodiments, the antibody comprises a single-chain Fv ("scFv"). scFvs are antibody fragments comprising the VH and VL domains of an antibody, wherein these domains are present in a single polypeptide chain. The scFv polypeptide may further comprise a polypeptide linker between the VH and VL domains which enables the scFv to form the desired structure for antigen binding. For a review of scFvs see Pluckthun in The Pharmacology of Monoclonal Antibodies, vol. 113, Rosenburg and Moore eds. Springer-Verlag, New York, pp. 269-315 (1994).

4. Humanized Antibodies

The present disclosure provides humanized antibodies that bind GFRAL, including human GFRAL. Humanized antibodies of the present disclosure may comprise one or more CDRs as shown in Tables 1-24. Various methods for humanizing non-human antibodies are known in the art. For example, a humanized antibody can have one or more amino acid residues introduced into it from a source that is non-human. These non-human amino acid residues are often referred to as "import" residues, which are typically taken from an "import" variable domain. Humanization may be performed, for example, following the method of Winter and co-workers (Jones et al. (1986) Nature 321:522-525; Riechmann et al. (1988) Nature 332:323-327; Verhoeyen et al. (1988) Science 239:1534-1536), by substituting hypervariable region sequences for the corresponding sequences of a human antibody.

In some cases, the humanized antibodies are constructed by CDR grafting, in which the amino acid sequences of the six complementarity determining regions (CDRs) of the parent non-human antibody (e.g., rodent) are grafted onto a human antibody framework. For example, Padlan et al. (FASEB J. 9:133-139, 1995) determined that only about one third of the residues in the CDRs actually contact the antigen, and termed these the "specificity determining residues," or SDRs. In the technique of SDR grafting, only the SDR residues are grafted onto the human antibody framework (see, e.g., Kashmiri et al., Methods 36: 25-34, 2005).

The choice of human variable domains, both light and heavy, to be used in making the humanized antibodies can be important to reduce antigenicity. For example, according to the so-called "best-fit" method, the sequence of the variable domain of a non-human (e.g., rodent) antibody is screened against the entire library of known human variable-domain sequences. The human sequence which is closest to that of the rodent may be selected as the human framework for the humanized antibody (Sims et al. (1993) J. Immunol. 151:2296; Chothia et al. (1987) J. Mol. Biol. 196:901. Another method uses a particular framework derived from the consensus sequence of all human antibodies of a particular subgroup of light or heavy chains. The same framework may be used for several different humanized antibodies (Carter et al. (1992) Proc. Natl. Acad. Sci. USA, 89:4285; Presta et al. (1993) J. Immunol., 151:2623. In some cases, the framework is derived from the consensus sequences of the most abundant human subclasses, $V_L6$ subgroup I ($V_L6I$) and $V_H$ subgroup III ($V_HIII$). In another method, human germline genes are used at the source of the framework regions.

In an alternative paradigm based on comparison of CDRs, called Superhumanization, FR homology is irrelevant. The method consists of comparison of the non-human sequence with the functional human germ line gene repertoire. Those genes encoding the same or closely related canonical structures to the murine sequences are then selected. Next, within the genes sharing the canonical structures with the non-human antibody, those with highest homology within the CDRs are chosen as FR donors. Finally, the non-human CDRs are grafted onto these FRs (see, e.g., Tan et al., J. Immunol. 169: 1119-1125, 2002).

It is further generally desirable that antibodies be humanized with retention of their affinity for the antigen and other favorable biological properties. To achieve this goal, according to one method, humanized antibodies are prepared by a process of analysis of the parental sequences and various conceptual humanized products using three-dimensional models of the parental and humanized sequences. Three-dimensional immunoglobulin models are commonly available and are familiar to those skilled in the art. Computer programs are available which illustrate and display probable three-dimensional conformational structures of selected candidate immunoglobulin sequences. These include, for example, WAM (Whitelegg and Rees, Protein Eng. 13: 819-824, 2000), Modeller (Sali and Blundell, J. Mol. Biol. 234: 779-815, 1993), and Swiss PDB Viewer (Guex and Peitsch, Electrophoresis 18: 2714-2713, 1997). Inspection of these displays permits analysis of the likely role of the residues in the functioning of the candidate immunoglobulin sequence, e.g., the analysis of residues that influence the ability of the candidate immunoglobulin to bind its antigen. In this way, FR residues can be selected and combined from the recipient and import sequences so that the desired antibody characteristic, such as increased affinity for the target antigen(s), is achieved. In general, the hypervariable region residues are directly and most substantially involved in influencing antigen binding.

Another method for antibody humanization is based on a metric of antibody humanness termed Human String Content (HSC). This method compares the mouse sequence with the repertoire of human germ line genes and the differences are scored as HSC. The target sequence is then humanized by maximizing its HSC rather than using a global identity measure to generate multiple diverse humanized variants. (Lazar et al., Mol. Immunol. 44: 1986-1998, 2007).

In addition to the methods described above, empirical methods may be used to generate and select humanized antibodies. These methods include those that are based upon the generation of large libraries of humanized variants and selection of the best clones using enrichment technologies or high throughput screening techniques. Antibody variants may be isolated from phage, ribosome and yeast display libraries as well as by bacterial colony screening (see, e.g., Hoogenboom, Nat. Biotechnol. 23: 1105-1116, 2005; Dufner et al., Trends Biotechnol. 24: 523-529, 2006; Feldhaus et al., Nat. Biotechnol. 21: 163-70, 2003; Schlapschy et al., Protein Eng. Des. Seli. 17: 847-60, 2004).

In the FR library approach, a collection of residue variants are introduced at specific positions in the FR followed by selection of the library to select the FR that best supports the grafted CDR. The residues to be substituted may include some or all of the "Vernier" residues identified as potentially contributing to CDR structure (see, e.g., Foote and Winter, J. Mol. Biol. 224: 487-499, 1992), or from the more limited set of target residues identified by Baca et al. (J. Biol. Chem. 272: 10678-10684, 1997).

In FR shuffling, whole FRs are combined with the non-human CDRs instead of creating combinatorial libraries of selected residue variants (see, e.g., Dall'Acqua et al., Methods 36: 43-60, 2005). The libraries may be screened for binding in a two-step selection process, first humanizing VL, followed by VH. Alternatively, a one-step FR shuffling process may be used. Such a process has been shown to be more efficient than the two-step screening, as the resulting antibodies exhibited improved biochemical and physicochemical properties including enhanced expression, increased affinity and thermal stability (see, e.g., Damschroder et al., *Mol. Immunol.* 44: 3049-60, 2007).

The "humaneering" method is based on experimental identification of essential minimum specificity determinants (MSDs) and is based on sequential replacement of non-human fragments into libraries of human FRs and assessment of binding. It begins with regions of the CDR3 of non-human VH and VL chains and progressively replaces other regions of the non-human antibody into the human FRs, including the CDR1 and CDR2 of both VH and VL. This methodology typically results in epitope retention and identification of antibodies from multiple sub-classes with distinct human V-segment CDRs. Humaneering allows for isolation of antibodies that are 91-96% homologous to human germline gene antibodies. (see, e.g., Alfenito, Cambridge Healthtech Institute's Third Annual PEGS, The Protein Engineering Summit, 2007).

The "human engineering" method involves altering an non-human antibody or antibody fragment, such as a mouse or chimeric antibody or antibody fragment, by making specific changes to the amino acid sequence of the antibody so as to produce a modified antibody with reduced immunogenicity in a human that nonetheless retains the desirable binding properties of the original non-human antibodies. Generally, the technique involves classifying amino acid residues of a non-human (e.g., mouse) antibody as "low risk", "moderate risk", or "high risk" residues. The classification is performed using a global risk/reward calculation that evaluates the predicted benefits of making particular substitution (e.g., for immunogenicity in humans) against the risk that the substitution will affect the resulting antibody's folding and/or are substituted with human residues. The particular human amino acid residue to be substituted at a given position (e.g., low or moderate risk) of a non-human (e.g., mouse) antibody sequence can be selected by aligning an amino acid sequence from the non-human antibody's variable regions with the corresponding region of a specific or consensus human antibody sequence. The amino acid residues at low or moderate risk positions in the non-human sequence can be substituted for the corresponding residues in the human antibody sequence according to the alignment. Techniques for making human engineered proteins are described in greater detail in Studnicka et al., Protein Engineering, 7: 805-814 (1994), U.S. Pat. Nos. 5,766,886, 5,770,196, 5,821,123, and 5,869,619, and PCT Application Publication WO 93/11794.

5. Human Antibodies

Human anti-GFRAL antibodies can be constructed by combining Fv clone variable domain sequence(s) selected from human-derived phage display libraries with known human constant domain sequences(s). Alternatively, human monoclonal GFRAL antibodies of the present disclosure can be made by the hybridoma method. Human myeloma and mouse-human heteromyeloma cell lines for the production of human monoclonal antibodies have been described, for example, by Kozbor *J. Immunol.*, 133: 3001 (1984); Brodeur et al., *Monoclonal Antibody Production Techniques and Applications*, pp. 51-63 (Marcel Dekker, Inc., New York, 1987); and Boerner et al., *J. Immunol.*, 147: 86 (1991).

It is also possible to produce transgenic animals (e.g., mice) that are capable, upon immunization, of producing a full repertoire of human antibodies in the absence of endogenous immunoglobulin production. Transgenic mice that express human antibody repertoires have been used to generate high-affinity human sequence monoclonal antibodies against a wide variety of potential drug targets (see, e.g., Jakobovits, A., *Curr. Opin. Biotechnol.* 1995, 6(5):561-6; Brüggemann and Taussing, *Curr. Opin. Biotechnol.* 1997, 8(4):455-8; U.S. Pat. Nos. 6,075,181 and 6,150,584; and Lonberg et al., *Nature Biotechnol.* 23: 1117-1125, 2005).

Alternatively, the human antibody may be prepared via immortalization of human B lymphocytes producing an antibody directed against a target antigen (e.g., such B lymphocytes may be recovered from an individual or may have been immunized in vitro) (see, e.g., Cole et al., *Monoclonal Antibodies and Cancer Therapy*, Alan R. Liss, p. 77 (1985); Boerner et al., *J. Immunol.*, 147 (1):86-95 (1991); and U.S. Pat. No. 5,750,373).

Gene shuffling can also be used to derive human antibodies from non-human, for example, rodent, antibodies, where the human antibody has similar affinities and specificities to the starting non-human antibody. According to this method, which is also called "epitope imprinting" or "guided selection", either the heavy or light chain variable region of a non-human antibody fragment obtained by phage display techniques as described herein is replaced with a repertoire of human V domain genes, creating a population of non-human chain/human chain scFv or Fab chimeras. Selection with antigen results in isolation of a non-human chain/human chain chimeric scFv or Fab wherein the human chain restores the antigen binding site destroyed upon removal of the corresponding non-human chain in the primary phage display clone, (e.g., the epitope guides (imprints) the choice of the human chain partner). When the process is repeated in order to replace the remaining non-human chain, a human antibody is obtained (see, e.g., PCT WO 93/06213; and Osbourn et al., Methods., 36, 61-68, 2005). Unlike traditional humanization of non-human antibodies by CDR grafting, this technique provides completely human antibodies, which have no FR or CDR residues of non-human origin. Examples of guided selection to humanize mouse antibodies towards cell surface antigens include the folate-binding protein present on ovarian cancer cells (see, e.g., Figini et al., *Cancer Res.*, 58, 991-996, 1998) and CD147, which is highly expressed on hepatocellular carcinoma (see, e.g., Bao et al., *Cancer Biol. Ther.*, 4, 1374-1380, 2005).

A potential disadvantage of the guided selection approach is that shuffling of one antibody chain while keeping the other constant could result in epitope drift. In order to maintain the epitope recognized by the non-human antibody, CDR retention can be applied (see, e.g., Klimka et al., *Br. J. Cancer.*, 83, 252-260, 2000; VH CDR2 Beiboer et al., *J. Mol. Biol.*, 296, 833-49, 2000) In this method, the non-human VH CDR3 is commonly retained, as this CDR may be at the center of the antigen-binding site and may be to be the most important region of the antibody for antigen recognition. In some instances, however, VH CDR3 and VL CDR3, as well as VH CDR3, VL CDR3 and VL CFR1, of the non-human antibody may be retained.

6. Bispecific Antibodies

Bispecific antibodies are monoclonal antibodies that have binding specificities for at least two different antigens. In certain embodiments, bispecific antibodies are human or humanized antibodies. In certain embodiments, one of the binding specificities is for GFRAL and the other is for any other antigen. In some embodiments, bispecific antibodies can bind to two different epitopes of GFRAL. Bispecific antibodies can be prepared as full length antibodies or antibody fragments (e.g., F(ab')$_2$ bispecific antibodies).

Methods for making bispecific antibodies are known in the art, such as, for example, by co-expression of two immunoglobulin heavy chain-light chain pairs, where the two heavy chains have different specificities (see, e.g., Milstein and Cuello, *Nature*, 305: 537 (1983)). For further details of generating bispecific antibodies see, for example, *Bispecific Antibodies*, Kontermann, ed., Springer-Verlag, Hiedelberg (2011).

7. Multivalent Antibodies

A multivalent antibody may be internalized (and/or catabolized) faster than a bivalent antibody by a cell expressing an antigen to which the antibodies bind. The antibodies of the present disclosure can be multivalent antibodies (which are other than of the IgM class) with three or more antigen binding sites (e.g., tetravalent antibodies), which can be readily produced by recombinant expression of nucleic acid encoding the polypeptide chains of the antibody. The multivalent antibody can comprise a dimerization domain and three or more antigen binding sites. In certain embodiments, the dimerization domain comprises (or consists of) an Fc region or a hinge region. In this scenario, the antibody will comprise an Fc region and three or more antigen binding sites amino-terminal to the Fc region. In certain embodiments, a multivalent antibody comprises (or consists of) three to about eight antigen binding sites. In one such embodiment, a multivalent antibody comprises (or consists of) four antigen binding sites. The multivalent antibody comprises at least one polypeptide chain (for example, two polypeptide chains), wherein the polypeptide chain(s) comprise two or more variable domains. For instance, the polypeptide chain(s) may comprise VD1-(X1)n-VD2-(X2)n-Fc, wherein VD1 is a first variable domain, VD2 is a second variable domain, Fc is one polypeptide chain of an Fc region, X1 and X2 represent an amino acid or polypeptide, and n is 0 or 1. For instance, the polypeptide chain(s) may comprise: VH-CH1-flexible linker-VH-CH1-Fc region chain; or VH-CH1-VH-CH1-Fc region chain. The multivalent antibody herein may further comprise at least two (for example, four) light chain variable domain polypeptides. The multivalent antibody herein may, for instance, comprise from about two to about eight light chain variable domain polypeptides. The light chain variable domain polypeptides contemplated here comprise a light chain variable domain and, optionally, further comprise a CL domain.

8. Fc Engineering

It may be desirable to modify an antibody to GFRAL via Fc engineering, including, with respect to effector function, for example, so as to decrease or remove antigen-dependent cell-mediated cyotoxicity (ADCC) and/or complement dependent cytotoxicity (CDC) of the antibody. This may be achieved by introducing one or more amino acid substitutions in an Fc region of the antibody. For example, substitutions into human IgG1 using IgG2 residues as positions 233-236 and IgG4 residues at positions 327, 330 and 331 were shown to greatly reduce ADCC and CDC (see, e.g., Armour et al., *Eur. J. Immunol.* 29:(8):2613-24 (1999); Shields et al., *J. Biol. Chem.* 276(9): 6591-604 (2001).

To increase the serum half life of the antibody, one may incorporate a salvage receptor binding epitope into the antibody (especially an antibody fragment), for example, as described in U.S. Pat. No. 5,739,277. Term "salvage receptor binding epitope" refers to an epitope of the Fc region of an IgG molecule (e.g., IgG1, IgG2, IgG3, or IgG4) that is responsible for increasing the in vivo serum half-life of the IgG molecule.

9. Alternative Binding Agents

The present disclosure encompasses non-immunoglobulin binding agents that specifically bind to the same epitope as an anti-GFRAL antibody disclosed herein. In some embodiments, a non-immunoglobulin binding agent is identified an agent that displaces or is displaced by an anti-GFRAL antibody of the present disclosure in a competitive binding assay. These alternative binding agents may include, for example, any of the engineered protein scaffolds known in the art. Such scaffolds may comprise one or more CDRs as shown in Tables 1-24. Such scaffolds include, for example, anticalins, which are based upon the lipocalin scaffold, a protein structure characterized by a rigid beta-barrel that supports four hypervariable loops which form the ligand binding site. Novel binding specificities may be engineered by targeted random mutagenesis in the loop regions, in combination with functional display and guided selection (see, e.g., Skerra (2008) *FEBS J.* 275: 2677-2683). Other suitable scaffolds may include, for example, adnectins, or monobodies, based on the tenth extracellular domain of human fibronectin III (see, e.g., Koide and Koide (2007) *Methods Mol. Biol.* 352: 95-109); affibodies, based on the Z domain of staphylococcal protein A (see, e.g., Nygren et al. (2008) *FEBS J.* 275: 2668-2676)); DARPins, based on ankyrin repeat proteins (see, e.g., Stumpp et al. (2008) *Drug. Discov. Today* 13: 695-701); fynomers, based on the SH3 domain of the human Fyn protein kinase Grabulovski et al. (2007) *J. Biol. Chem.* 282: 3196-3204); affitins, based on Sac7d from *Sulfolobus acidolarius* (see, e.g., Krehenbrink et al. (2008) *J. Mol. Biol.* 383: 1058-1068); affilins, based on human y-B-crystallin (see, e.g., Ebersbach et al. (2007) *J. Mol. Biol.* 372: 172-185); avimers, based on the A domains of membrane receptor proteins (see, e.g., Silverman et al. (2005) *Biotechnol.* 23: 1556-1561); cysteine-rich knottin peptides (see, e.g., Kolmar (2008) *FEBS J.* 275: 2684-2690); and engineered Kunitz-type inhibitors (see, e.g., Nixon and Wood (2006) *Curr. Opin. Drug. Discov. Dev.* 9: 261-268) For a review, see, for example, Gebauer and Skerra (2009) *Curr. Opin. Chem. Biol.* 13: 245-255.

Antibody Variants

In some embodiments, amino acid sequence modification(s) of the antibodies that bind to GFRAL described herein are contemplated. For example, it may be desirable to improve the binding affinity and/or other biological properties of the antibody, including but not limited to specificity, thermostability, expression level, effector functions, glycosylation, reduced immunogenicity or solubility. This, in addition to the anti-GFRAL antibodies described herein, it is contemplated that anti-GFRAL antibody variants can be prepared. For example, anti-GFRAL antibody variants can be prepared by introducing appropriate nucleotide changes into the encoding DNA, and/or by synthesis of the desired antibody or polypeptide. Those skilled in the art will appreciate that amino acid changes may alter post-translational processes of the anti-GFRAL antibody, such as changing the number or position of glycosylation sites or altering the membrane anchoring characteristics.

In some embodiments, antibodies provided herein are chemically modified, for example, by the association with, including covalent attachment of, any type of molecule with the antibody. The antibody derivatives may include antibodies that have been chemically modified, for example, by glycosylation, acetylation, pegylation, phosphorylation, amidation, derivatization by known protecting/blocking groups, proteolytic cleavage, linkage to a cellular ligand or other protein, etc. Any of numerous chemical modifications may be carried out by known techniques, including, but not limited to, specific chemical cleavage, acetylation, formulation, metabolic synthesis of tunicamycin, etc. Additionally, the antibody may contain one or more non-classical amino acids.

Variations may be a substitution, deletion or insertion of one or more codons encoding the antibody or polypeptide that results in a change in the amino acid sequence as compared with the native sequence antibody or polypeptide. Amino acid substitutions can be the result of replacing one amino acid with another amino acid having similar structural and/or chemical properties, such as the replacement of a leucine with a serine, e.g., conservative amino acid replacements. Insertions or deletions may optionally be in the range of about 1 to 5 amino acids. In certain embodiments, the substitution, deletion or insertion includes less than 25 amino acid substitutions, less than 20 amino acid substitutions, less than 15 amino acid substitutions, less than 10 amino acid substitutions, less than 5 amino acid substitutions, less than 4 amino acid substitutions, less than 3 amino acid substitutions, or less than 2 amino acid substitutions relative to the original molecule. In a specific embodiment, the substitution is a conservative amino acid substitution made at one or more predicted non-essential amino acid residues. The variation allowed may be determined by systematically making insertions, deletions or substitutions of amino acids in the sequence and testing the resulting variants for activity exhibited by the full-length or mature native sequence.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue. Other insertional variants of the antibody molecule include the fusion to the N- or C-terminus of the antibody to an enzyme (e.g., for antibody-directed enzyme prodrug therapy) or a polypeptide which increases the serum half-life of the antibody.

Substantial modifications in the biological properties of the antibody are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Alternatively, conservative (e.g., within an amino acid group with similar properties and/or sidechains) substitutions may be made, so as to maintain or not significantly change the properties. Amino acids may be grouped according to similarities in the properties of their side chains (see, e.g., A. L. Lehninger, in Biochemistry, 2nd Ed., pp. 73-75, Worth Publishers, New York (1975)): (1) non-polar: Ala (A), Val (V), Leu (L), Ile (I), Pro (P), Phe (F), Trp (W), Met (M); (2) uncharged polar: Gly (G), Ser (S), Thr (T), Cys (C), Tyr (Y), Asn (N), Gln (Q); (3) acidic: Asp (D), Glu (E); and (4) basic: Lys (K), Arg (R), His (H).

Alternatively, naturally occurring residues may be divided into groups based on common side-chain properties: (1) hydrophobic: Norleucine, Met, Ala, Val, Leu, Ile; (2) neutral hydrophilic: Cys, Ser, Thr, Asn, Gln; (3) acidic: Asp, Glu; (4) basic: His, Lys, Arg; (5) residues that influence chain orientation: Gly, Pro; and (6) aromatic: Trp, Tyr, Phe.

Non-conservative substitutions entail exchanging a member of one of these classes for another class. Such substituted residues also may be introduced into the conservative substitution sites or, into the remaining (non-conserved) sites. Accordingly, in one embodiment, an antibody or fragment thereof that binds to a GFRAL epitope comprises an amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical to the amino acid sequence of a murine monoclonal antibody described herein.

In one embodiment, an antibody or fragment thereof that binds to a GFRAL epitope comprises an amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical to an amino acid sequence depicted in Tables 1-24. In yet another embodiment, an antibody or fragment thereof that binds to a GFRAL epitope comprises a VH CDR and/or a VL CDR amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical to a VH CDR amino acid sequence depicted in Tables 1-24 and/or a VL CDR amino acid sequence depicted in Tables 1-24. The variations can be made using methods known in the art such as oligonucleotide-mediated (site-directed) mutagenesis, alanine scanning, and PCR mutagenesis. Site-directed mutagenesis (see, e.g., Carter et al., Nucl. Acids Res., 13:4331 (1986); Zoller et al., Nucl. Acids Res., 10:6487 (1987)), cassette mutagenesis (see, e.g., Wells et al., Gene, 34:315 (1985)), restriction selection mutagenesis (see, e.g., Wells et al., Philos. Trans. R. Soc. London SerA, 317:415 (1986)) or other known techniques can be performed on the cloned DNA to produce the anti-GFRAL antibody variant DNA.

Any cysteine residue not involved in maintaining the proper conformation of the anti-GFRAL antibody also may be substituted, for example, with another amino acid such as alanine or serine, to improve the oxidative stability of the molecule and prevent aberrant crosslinking. Conversely, cysteine bond(s) may be added to the anti-GFRAL antibody to improve its stability (e.g., where the antibody is an antibody fragment such as an Fv fragment).

In some embodiments, an anti-GFRAL antibody molecule of the present disclosure is a "de-immunized" antibody. A "de-immunized" anti-GFRAL antibody is an antibody derived from a humanized or chimeric anti-GFRAL antibody, that has one or more alterations in its amino acid sequence resulting in a reduction of immunogenicity of the antibody, compared to the respective original non-de-immunized antibody. One of the procedures for generating such antibody mutants involves the identification and removal of T-cell epitopes of the antibody molecule. In a first step, the immunogenicity of the antibody molecule can be determined by several methods, for example, by in vitro determination of T-cell epitopes or in silico prediction of such epitopes, as known in the art. Once the critical residues for T-cell epitope function have been identified, mutations can be made to remove immunogenicity and retain antibody activity. For review, see, for example, Jones et al., Methods in Molecular Biology 525: 405-423, 2009.

1. In Vitro Affinity Maturation

In some embodiments, antibody variants having an improved property such as affinity, stability, or expression level as compared to a parent antibody may be prepared by in vitro affinity maturation. Like the natural prototype, in vitro affinity maturation is based on the principles of mutation and selection. Libraries of antibodies are displayed as Fab, scFv or V domain fragments either on the surface of an organism (e.g., phage, bacteria, yeast or mammalian cell) or in association (e.g., covalently or non-covalently) with their encoding mRNA or DNA. Affinity selection of the displayed antibodies allows isolation of organisms or complexes carrying the genetic information encoding the antibodies. Two or three rounds of mutation and selection using display methods such as phage display usually results in antibody fragments with affinities in the low nanomolar range. Preferred affinity matured antibodies will have nanomolar or even picomolar affinities for the target antigen.

Phage display is a widespread method for display and selection of antibodies. The antibodies are displayed on the surface of Fd or M13 bacteriophages as fusions to the bacteriophage coat protein. Selection involves exposure to antigen to allow phage-displayed antibodies to bind their targets, a process referred to as "panning." Phage bound to antigen are recovered and infected in bacteria to produce phage for further rounds of selection. For review, see, for example, Hoogenboom, *Methods. Mol. Biol.* 178: 1-37, 2002; Bradbury and Marks, *J. Immuno. Methods* 290: 29-49, 2004).

In a yeast display system (see, e.g., Boder et al., *Nat. Biotech.* 15: 553-57, 1997; Chao et al., *Nat. Protocols* 1:755-768, 2006), the antibody may be displayed as single-chain variable fusions (scFv) in which the heavy and light chains are connected by a flexible linker. The scFv is fused to the adhesion subunit of the yeast agglutinin protein Aga2p, which attaches to the yeast cell wall through disulfide bonds to Aga1p. Display of a protein via Aga2p projects the protein away from the cell surface, minimizing potential interactions with other molecules on the yeast cell wall. Magnetic separation and flow cytometry are used to screen the library to select for antibodies with improved affinity or stability. Binding to a soluble antigen of interest is determined by labeling of yeast with biotinylated antigen and a secondary reagent such as streptavidin conjugated to a fluorophore. Variations in surface expression of the antibody can be measured through immunofluorescence labeling of either the hemagglutinin or c-Myc epitope tag flanking the scFv. Expression has been shown to correlate with the stability of the displayed protein, and thus antibodies can be selected for improved stability as well as affinity (see, e.g., Shusta et al., *J. Mol. Biol.* 292: 949-956, 1999). An additional advantage of yeast display is that displayed proteins are folded in the endoplasmic reticulum of the eukaryotic yeast cells, taking advantage of endoplasmic reticulum chaperones and quality-control machinery. Once maturation is complete, antibody affinity can be conveniently 'titrated' while displayed on the surface of the yeast, eliminating the need for expression and purification of each clone. A theoretical limitation of yeast surface display is the potentially smaller functional library size than that of other display methods; however, a recent approach uses the yeast cells' mating system to create combinatorial diversity estimated to be $10^{14}$ in size (see, e.g., US Patent Publication 2003/0186, 374; Blaise et al., *Gene* 342: 211-218, 2004).

In ribosome display, antibody-ribosome-mRNA (ARM) complexes are generated for selection in a cell-free system. The DNA library coding for a particular library of antibodies is genetically fused to a spacer sequence lacking a stop codon. This spacer sequence, when translated, is still attached to the peptidyl tRNA and occupies the ribosomal tunnel, and thus allows the protein of interest to protrude out of the ribosome and fold. The resulting complex of mRNA, ribosome, and protein can bind to surface-bound ligand, allowing simultaneous isolation of the antibody and its encoding mRNA through affinity capture with the ligand. The ribosome-bound mRNA is then reversed transcribed back into cDNA, which can then undergo mutagenesis and be used in the next round of selection (see, e.g., Fukuda et al., *Nucleic Acids Res.* 34, e127, 2006). In mRNA display, a covalent bond between antibody and mRNA is established using puromycin as an adaptor molecule (Wilson et al., *Proc. Natl. Acad. Sci. USA* 98, 3750-3755, 2001).

As these methods are performed entirely in vitro, they provide two main advantages over other selection technologies. First, the diversity of the library is not limited by the transformation efficiency of bacterial cells, but only by the number of ribosomes and different mRNA molecules present in the test tube. Second, random mutations can be introduced easily after each selection round, for example, by non-proofreading polymerases, as no library must be transformed after any diversification step.

Diversity may be introduced into the CDRs or the whole V genes of the antibody libraries in a targeted manner or via random introduction. The former approach includes sequentially targeting all the CDRs of an antibody via a high or low level of mutagenesis or targeting isolated hot spots of somatic hypermutations (see, e.g., Ho, et al., *J. Biol. Chem.* 280: 607-617, 2005) or residues suspected of affecting affinity on experimental basis or structural reasons. Random mutations can be introduced throughout the whole V gene using *E. coli* mutator strains, error-prone replication with DNA polymerases (see, e.g., Hawkins et al., *J. Mol. Biol.* 226: 889-896, 1992) or RNA replicases. Diversity may also be introduced by replacement of regions that are naturally diverse via DNA shuffling or similar techniques (see, e.g., Lu et al., *J. Biol. Chem.* 278: 43496-43507, 2003; U.S. Pat. No. 5,565,332; U.S. Pat. No. 6,989,250). Alternative techniques target hypervariable loops extending into framework-region residues (see, e.g., Bond et al., *J. Mol. Biol.* 348: 699-709, 2005) employ loop deletions and insertions in CDRs or use hybridization-based diversification (see, e.g., US Patent Publication No. 2004/0005709). Additional methods of generating diversity in CDRs are disclosed, for example, in U.S. Pat. No. 7,985,840.

Screening of the libraries can be accomplished by various techniques known in the art. For example, GFRAL can be immobilized onto solid supports, columns, pins or cellulose/poly(vinylidene fluoride) membranes/other filters, expressed on host cells affixed to adsorption plates or used in cell sorting, or conjugated to biotin for capture with streptavidin-coated beads, or used in any other method for panning display libraries.

For review of in vitro affinity maturation methods, see, e.g., Hoogenboom, *Nature Biotechnology* 23: 1105-1116, 2005 and Quiroz and Sinclair, Revista Ingeneria Biomedia 4: 39-51, 2010 and references therein.

2. Modifications of Anti-GFRAL Antibodies

Covalent modifications of anti-GFRAL antibodies are included within the scope of the present disclosure. Covalent modifications include reacting targeted amino acid residues of an anti-GFRAL antibody with an organic derivatizing agent that is capable of reacting with selected side chains or the N- or C-terminal residues of the anti-GFRAL antibody. Other modifications include deamidation of glutaminyl and asparaginyl residues to the corresponding glutamyl and aspartyl residues, respectively, hydroxylation of proline and lysine, phosphorylation of hydroxyl groups of seryl or threonyl residues, methylation of the α-amino groups of lysine, arginine, and histidine side chains (see, e.g., T. E. Creighton, *Proteins: Structure and Molecular Properties*, W.H. Freeman & Co., San Francisco, pp. 79-86 (1983)), acetylation of the N-terminal amine, and amidation of any C-terminal carboxyl group.

Other types of covalent modification of the anti-GFRAL antibody included within the scope of this present disclosure include altering the native glycosylation pattern of the antibody or polypeptide (see, e.g., Beck et al., *Curr. Pharm. Biotechnol.* 9: 482-501, 2008; Walsh, *Drug Discov. Today* 15: 773-780, 2010), and linking the antibody to one of a variety of nonproteinaceous polymers, e.g., polyethylene glycol (PEG), polypropylene glycol, or polyoxyalkylenes, in the manner set forth, for example, in U.S. Pat. Nos. 4,640,835; 4,496,689; 4,301,144; 4,670,417; 4,791,192 or 4,179,337.

An anti-GFRAL antibody of the present disclosure may also be modified to form chimeric molecules comprising an anti-GFRAL antibody fused to another, heterologous polypeptide or amino acid sequence, for example, an epitope tag (see, e.g., Terpe, *Appl. Microbiol. Biotechnol.* 60: 523-533, 2003) or the Fc region of an IgG molecule (see, e.g., Aruffo, "Immunoglobulin fusion proteins" in Antibody Fusion Proteins, S. M. Chamow and A. Ashkenazi, eds., Wiley-Liss, New York, 1999, pp. 221-242).

Also provided herein are fusion proteins comprising an antibody provided herein that binds to a GFRAL antigen and a heterologous polypeptide. In some embodiments, the heterologous polypeptide to which the antibody is fused is useful for targeting the antibody to cells having cell surface-expressed GFRAL.

Also provided herein are panels of antibodies that bind to a GFRAL antigen. In specific embodiments, panels of antibodies have different association rate constants different dissociation rate constants, different affinities for GFRAL antigen, and/or different specificities for a GFRAL antigen. In some embodiments, the panels comprise or consist of about 10, about 25, about 50, about 75, about 100, about 125, about 150, about 175, about 200, about 250, about 300, about 350, about 400, about 450, about 500, about 550, about 600, about 650, about 700, about 750, about 800, about 850, about 900, about 950, or about 1000 antibodies or more. Panels of antibodies can be used, for example, in 96 well or 384 well plates, such as for assays such as ELISAs.

Preparation of Anti-GFRAL Antibodies

Anti-GFRAL antibodies may be produced by culturing cells transformed or transfected with a vector containing anti-GFRAL antibody-encoding nucleic acids. Polynucleotide sequences encoding polypeptide components of the antibody of the present disclosure can be obtained using standard recombinant techniques. Desired polynucleotide sequences may be isolated and sequenced from antibody producing cells such as hybridomas cells. Alternatively, polynucleotides can be synthesized using nucleotide synthesizer or PCR techniques. Once obtained, sequences encoding the polypeptides are inserted into a recombinant vector capable of replicating and expressing heterologous polynucleotides in host cells. Many vectors that are available and known in the art can be used for the purpose of the present disclosure. Selection of an appropriate vector will depend mainly on the size of the nucleic acids to be inserted into the vector and the particular host cell to be transformed with the vector. Host cells suitable for expressing antibodies of the present disclosure include prokaryotes such as Archaebacteria and Eubacteria, including Gram-negative or Gram-positive organisms, eukaryotic microbes such as filamentous fungi or yeast, invertebrate cells such as insect or plant cells, and vertebrate cells such as mammalian host cell lines. Host cells are transformed with the above-described expression vectors and cultured in conventional nutrient media modified as appropriate for inducing promoters, selecting transformants, or amplifying the genes encoding the desired sequences. Antibodies produced by the host cells are purified using standard protein purification methods as known in the art.

Methods for antibody production including vector construction, expression and purification are further described, in Plückthun et al., (1996) in *Antibody Engineering: Producing antibodies in Escherichia coli: From PCR to fermentation* (McCafferty, J., Hoogenboom, H. R., and Chiswell, D. J., eds), 1 Ed., pp. 203-252, IRL Press, Oxford; Kwong, K. & Rader, C., *E. coli* expression and purification of Fab antibody fragments, Current protocols in protein science editorial board John E Coligan et al., Chapter 6, Unit 6.10 (2009); Tachibana and Takekoshi, "Production of Antibody Fab Fragments in *Escherichia coli*," in *Antibody Expression and Production*, M. Al-Rubeai, Ed., Springer, New York, 2011; *Therapeutic Monoclonal Antibodies: From Bench to Clinic* (ed Z. An), John Wiley & Sons, Inc., Hoboken, N.J., USA.

It is, of course, contemplated that alternative methods, which are well known in the art, may be employed to prepare anti-GFRAL antibodies. For instance, the appropriate amino acid sequence, or portions thereof, may be produced by direct peptide synthesis using solid-phase techniques (see, e.g., Stewart et al., *Solid-Phase Peptide Synthesis*, W.H. Freeman Co., San Francisco, Calif. (1969); Merrifield, *J. Am. Chem. Soc.*, 85:2149-2154 (1963)). In vitro protein synthesis may be performed using manual techniques or by automation. Various portions of the anti-GFRAL antibody may be chemically synthesized separately and combined using chemical or enzymatic methods to produce the desired anti-GFRAL antibody. Alternatively, antibodies may be purified from cells or bodily fluids, such as milk, of a transgenic animal engineered to express the antibody, as disclosed, for example, in U.S. Pat. No. 5,545,807 and U.S. Pat. No. 5,827,690.

Immunoconjugates

The present disclosure also provides conjugates comprising any one of the anti-GFRAL antibodies of the present disclosure covalently bound, including by a synthetic linker, to one or more non-antibody agents.

A variety of radioactive isotopes are available for the production of radioconjugated antibodies. Examples include $At^{211}$, I4, I4, Y4, Re4, Re4, Sm4, Bi4, P4, Pb4 and radioactive isotopes of Lu. When the conjugate is used for detection, it may comprise a radioactive atom for scintigraphic studies, for example tc4 or I4, or a spin label for nuclear magnetic resonance (NMR) imaging (also known as magnetic resonance imaging, MRI), such as iodine-123 again, iodine-131, indium-111, fluorine-19, carbon-13, nitrogen-15, oxygen-17, gadolinium, manganese or iron. The radioisotopes may be incorporated in the conjugate in known ways as described, e.g., in Reilly, "The radiochemistry of monoclonal antibodies and peptides," in Monoclonal Antibody and Peptide-Targeted Radiotherapy of Cancer, R. M. Reilly, ed., Wiley, Hoboken N.J., 2010.

In some embodiments, antibodies provided herein are conjugated or recombinantly fused to a diagnostic, detectable or therapeutic agent or any other molecule. The conjugated or recombinantly fused antibodies can be useful, for example, for monitoring or prognosing the onset, development, progression and/or severity of a β-cell defective disease, disorder or condition as part of a clinical testing procedure, such as determining the efficacy of a particular therapy.

Such diagnosis and detection can accomplished, for example, by coupling the antibody to detectable substances including, but not limited to, various enzymes, such as, but not limited to, horseradish peroxidase, alkaline phosphatase, beta-galactosidase, or acetylcholinesterase; prosthetic groups, such as, but not limited to, streptavidin/biotin and avidin/biotin; fluorescent materials, such as, but not limited to, umbelliferone, fluorescein, fluorescein isothiocynate, rhodamine, dichlorotriazinylamine fluorescein, dansyl chloride or phycoerythrin; luminescent materials, such as, but not limited to, luminol; bioluminescent materials, such as but not limited to, luciferase, luciferin, and aequorin; chemiluminescent material, such as but not limited to, an acridinium based compound or a HALOTAG; radioactive materials, such as, but not limited to, iodine ($^{131}$I, $^{125}$I, $^{123}$I, and $^{121}$I), carbon ($^{14}$C), sulfur ($^{35}$S), tritium ($^{3}$H), indium ($^{115}$In, $^{113}$In, $^{112}$In, and $^{111}$In), technetium ($^{99}$Tc), thallium ($^{201}$Ti), gallium ($^{68}$Ga, $^{67}$Ga), palladium ($^{103}$Pd), molybdenum ($^{99}$Mo), xenon ($^{133}$Xe), fluorine ($^{18}$F), $^{153}$Sm, $^{177}$Lu, $^{159}$Gd, $^{149}$Pm, $^{140}$La, $^{175}$Yb, $^{166}$Ho, $^{90}$Y, $^{47}$Sc, $^{186}$Re, $^{188}$Re, $^{142}$Pr, $^{105}$Rh, $^{97}$Ru, $^{68}$Ge, $^{57}$Co, $^{65}$Zn, $^{85}$Sr, $^{32}$P, $^{153}$Gd, $^{169}$Yb, $^{51}$Cr, $^{54}$Mn, $^{75}$Se, $^{113}$Sn, and $^{117}$Sn; and positron emitting metals using various positron emission tomographies, and non-radioactive paramagnetic metal ions.

Also provided herein are antibodies that are conjugated or recombinantly fused to a therapeutic moiety (or one or more therapeutic moieties), as well as uses thereof. The antibody may be conjugated or recombinantly fused to a therapeutic moiety, including a cytotoxin such as a cytostatic or cytocidal agent, a therapeutic agent or a radioactive metal ion such as alpha-emitters. A cytotoxin or cytotoxic agent includes any agent that is detrimental to cells.

Further, an antibody provided herein may be conjugated or recombinantly fused to a therapeutic moiety or drug moiety that modifies a given biological response. Therapeutic moieties or drug moieties are not to be construed as limited to classical chemical therapeutic agents. For example, the drug moiety may be a protein, peptide, or polypeptide possessing a desired biological activity. Such proteins may include, for example, a toxin such as abrin, ricin A, *pseudomonas* exotoxin, cholera toxin, or diphtheria toxin; a protein such as tumor necrosis factor, γ-interferon, α-interferon, nerve growth factor, platelet derived growth factor, tissue plasminogen activator, an apoptotic agent, e.g., TNF-γ, TNF-γ, AIM I (see, e.g., International Publication No. WO 97/33899), AIM II (see, e.g., International Publication No. WO 97/34911), Fas Ligand (see, e.g., Takahashi et al., 1994, J. Immunol., 6:1567-1574), and VEGF (see, e.g., International Publication No. WO 99/23105), an anti-angiogenic agent, including, for example angiostatin, endostatin or a component of the coagulation pathway (e.g., tissue factor); or, a biological response modifier such as, for example, a lymphokine (e.g., interferon gamma, interleukin-1 ("IL-1"), interleukin-2 ("IL-2"), interleukin-5 ("IL-5"), interleukin-6 ("IL-6"), interleukin-7 ("IL-7"), interleukin 9 ("IL-9"), interleukin-10 ("IL-10"), interleukin-12 ("IL-12"), interleukin-15 ("IL-15"), interleukin-23 ("IL-23"), granulocyte macrophage colony stimulating factor ("GM-CSF"), and granulocyte colony stimulating factor ("G-CSF")), or a growth factor (e.g., growth hormone ("GH")), or a coagulation agent (e.g., calcium, vitamin K, tissue factors, such as but not limited to, Hageman factor (factor XII), high-molecular-weight kininogen (HMWK), prekallikrein (PK), coagulation proteins-factors II (prothrombin), factor V, XIIa, VIII, XIIIa, XI, XIa, IX, IXa, X, phospholipid, and fibrin monomer).

Also provided herein are antibodies that are recombinantly fused or chemically conjugated (covalent or non-covalent conjugations) to a heterologous protein or polypeptide (or fragment thereof, for example, to a polypeptide of about 10, about 20, about 30, about 40, about 50, about 60, about 70, about 80, about 90 or about 100 amino acids) to generate fusion proteins, as well as uses thereof. In particular, provided herein are fusion proteins comprising an antigen-binding fragment of an antibody provided herein (e.g., a Fab fragment, Fd fragment, Fv fragment, F(ab)$_2$ fragment, a VH domain, a VH CDR, a VL domain or a VL CDR) and a heterologous protein, polypeptide, or peptide. In one embodiment, the heterologous protein, polypeptide, or peptide that the antibody is fused to is useful for targeting the antibody to a particular cell type, such as a cell that expresses GFRAL. For example, an antibody that binds to a cell surface receptor expressed by a particular cell type (e.g., an immune cell) may be fused or conjugated to a modified antibody provided herein.

In addition, an antibody provided herein can be conjugated to therapeutic moieties such as a radioactive metal ion, such as alpha-emitters such as $^{213}$Bi or macrocyclic chelators useful for conjugating radiometal ions, including but not limited to, $^{131}$In, $^{131}$LU, $^{131}$Y, $^{131}$Ho, $^{131}$Sm, to polypeptides. In certain embodiments, the macrocyclic chelator is 1,4,7, 10-tetraazacyclododecane-N,N',N",N'"-tetraacetic acid (DOTA) which can be attached to the antibody via a linker molecule. Such linker molecules are commonly known in the art and described, for example, in Denardo et al., 1998, *Clin Cancer Res.* 4(10):2483-90; Peterson et al., 1999, *Bioconjug. Chem.* 10(4):553-7; and Zimmerman et al., 1999, *Nucl. Med. Biol.* 26(8):943-50.

Moreover, antibodies provided herein can be fused to marker or "tag" sequences, such as a peptide to facilitate purification. In specific embodiments, the marker or tag amino acid sequence is a hexa-histidine peptide, such as the tag provided in a pQE vector (see, e.g., QIAGEN, Inc.), among others, many of which are commercially available. For example, as described in Gentz et al., 1989, Proc. Natl. Acad. Sci. USA 86:821-824, hexa-histidine provides for convenient purification of the fusion protein. Other peptide tags useful for purification include, but are not limited to, the hemagglutinin ("HA") tag, which corresponds to an epitope derived from the influenza hemagglutinin protein (Wilson et al., 1984, Cell 37:767), and the "FLAG" tag.

Methods for fusing or conjugating therapeutic moieties (including polypeptides) to antibodies are well known, (see, e.g., Arnon et al., "Monoclonal Antibodies For Immunotargeting Of Drugs In Cancer Therapy", in Monoclonal Antibodies And Cancer Therapy, Reisfeld et al. (eds.), pp. 243-56 (Alan R. Liss, Inc. 1985); Hellstrom et al., "Antibodies For Drug Delivery", in Controlled Drug Delivery (2nd Ed.), Robinson et al. (eds.), pp. 623-53 (Marcel Dekker, Inc. 1987); Thorpe, "Antibody Carriers Of Cytotoxic Agents In Cancer Therapy: A Review", in Monoclonal Antibodies 84: Biological And Clinical Applications, Pinchera et al. (eds.), pp. 475-506 (1985); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), pp. 303-16 (Academic Press 1985), Thorpe et al., 1982, Immunol. Rev. 62:119-58; U.S. Pat. Nos. 5,336,603, 5,622,929, 5,359,046, 5,349,053, 5,447,851, 5,723,125, 5,783,181, 5,908,626, 5,844,095, and 5,112,946; EP 307,434; EP 367, 166; EP 394,827; PCT publications WO 91/06570, WO 96/04388, WO 96/22024, WO 97/34631, and WO 99/04813; Ashkenazi et al., Proc. Natl. Acad. Sci. USA, 88: 10535-10539, 1991; Traunecker et al., Nature, 331:84-86, 1988; Zheng et al., J. Immunol., 154:5590-5600, 1995; Vil et al., Proc. Natl. Acad. Sci. USA, 89:11337-11341, 1992).

Fusion proteins may be generated, for example, through the techniques of gene-shuffling, motif-shuffling, exon-shuffling, and/or codon-shuffling (collectively referred to as "DNA shuffling"). DNA shuffling may be employed to alter the activities of anti-GFRAL antibodies as provided herein, including, for example, antibodies with higher affinities and lower dissociation rates (see, e.g., U.S. Pat. Nos. 5,605,793, 5,811,238, 5,830,721, 5,834,252, and 5,837,458; Patten et al., 1997, Curr. Opinion Biotechnol. 8:724-33; Harayama, 1998, Trends Biotechnol. 16(2):76-82; Hansson et al., 1999, J. Mol. Biol. 287:265-76; and Lorenzo and Blasco, 1998, Biotechniques 24(2):308-313). Antibodies, or the encoded antibodies, may be altered by being subjected to random mutagenesis by error-prone PCR, random nucleotide insertion or other methods prior to recombination. A polynucleotide encoding an antibody provided herein may be recombined with one or more components, motifs, sections, parts, domains, fragments, etc. of one or more heterologous molecules.

An antibody provided herein can also be conjugated to a second antibody to form an antibody heteroconjugate as described, for example, in U.S. Pat. No. 4,676,980.

The therapeutic moiety or drug conjugated or recombinantly fused to an antibody provided herein that binds to GFRAL (e.g., a GFRAL polypeptide, fragment, epitope) should be chosen to achieve the desired prophylactic or therapeutic effect(s). In certain embodiments, the antibody is a modified antibody. A clinician or other medical personnel may consider, for example, the following when deciding on which therapeutic moiety or drug to conjugate or recombinantly fuse to an antibody provided herein: the nature of the disease, the severity of the disease, and the condition of the subject.

Antibodies that bind to GFRAL as provided herein may also be attached to solid supports, which are particularly useful for immunoassays or purification of the target antigen. Such solid supports include, but are not limited to, glass, cellulose, polyacrylamide, nylon, polystyrene, polyvinyl chloride or polypropylene.

The linker may be a "cleavable linker" facilitating release of the conjugated agent in the cell, but non-cleavable linkers are also contemplated herein. Linkers for use in the conjugates of the present disclosure include without limitation acid labile linkers (e.g., hydrazone linkers), disulfide-containing linkers, peptidase-sensitive linkers (e.g., peptide linkers comprising amino acids, for example, valine and/or citrulline such as citrulline-valine or phenylalanine-lysine), photolabile linkers, dimethyl linkers (see, e.g., Chari et al., *Cancer Research* 52:127-131 (1992); U.S. Pat. No. 5,208,020), thioether linkers, or hydrophilic linkers designed to evade multidrug transporter-mediated resistance (see, e.g., Kovtun et al., *Cancer Res.* 70: 2528-2537, 2010).

Conjugates of the antibody and agent may be made using a variety of bifunctional protein coupling agents such as BMPS, EMCS, GMBS, HBVS, LC-SMCC, MBS, MPBH, SBAP, SIA, SIAB, SMCC, SMPB, SMPH, sulfo-EMCS, sulfo-GMBS, sulfo-KMUS, sulfo-MBS, sulfo-SIAB, sulfo-SMCC, and sulfo-SMPB, and SVSB (succinimidyl-(4-vinylsulfone)benzoate). The present disclosure further contemplates that conjugates of antibodies and agents may be prepared using any suitable methods as disclosed in the art, (see, e.g., in *Bioconjugate Techniques,* 2nd Ed., G. T. Hermanson, ed., Elsevier, San Francisco, 2008).

Conventional conjugation strategies for antibodies and agents have been based on random conjugation chemistries involving the ε-amino group of Lys residues or the thiol group of Cys residues, which results in heterogenous conjugates. Recently developed techniques allow site-specific conjugation to antibodies, resulting in homogeneous loading and avoiding conjugate subpopulations with altered antigen-binding or pharmacokinetics. These include engineering of "thiomabs" comprising cysteine substitutions at positions on the heavy and light chains that provide reactive thiol groups and do not disrupt immunoglobulin folding and assembly or alter antigen binding (see, e.g., Junutula et al., *J. Immunol. Meth.* 332: 41-52 (2008); Junutula et al., *Nat. Biotechnol.* 26: 925-932, 2008). In another method, selenocysteine is cotranslationally inserted into an antibody sequence by recoding the stop codon UGA from termination to selenocysteine insertion, allowing site specific covalent conjugation at the nucleophilic selenol group of selenocysteine in the presence of the other natural amino acids (see, e.g., Hofer et al., *Proc. Natl. Acad. Sci. USA* 105: 12451-12456 (2008); Hofer et al., *Biochemistry* 48(50): 12047-12057, 2009).

Pharmaceutical Formulations

Anti-GFRAL antibodies of the present disclosure may be administered by any route appropriate to the disease, disorder or condition to be treated. The antibody will typically be administered parenterally, for example, infusion, subcutaneous, intramuscular, intravenous, intradermal, intrathecal and epidural. The antibody dose will vary, including depending on the nature and/or severity of the disease or disorder as well as the condition of the subject, may include doses between 1 mg and 100 mg. Doses may also include those between 1 mg/kg and 15 mg/kg. In some embodiments, the dose is between about 5 mg/kg and about 7.5 mg/kg. In some embodiments, the dose is about 5 mg/kg. In some embodiments, the dose is about 7.5 mg/kg. Flat doses selected from the group consisting of: (a) 375-400 mg every two weeks and (b) 550-600 mg every three weeks. In some embodiments, the flat dose is 375-400 mg every two weeks. In some embodiments, the flat dose is 550-600 mg every three weeks. In some embodiments the flat dose is 400 mg every two weeks. In some embodiments the flat dose is 600 mg every three weeks. In some embodiments of sequential dosing, a first dose and a second dose are each between 1 mg/kg and 15 mg/kg with the second dose following the first does by between 1 and 4 weeks. In some embodiments, the first dose and the second dose are each between 5 mg/kg and 7.5 mg/kg and the second dose follows the first dose by between 2 and 3 weeks. In some embodiments, the first dose and the second dose are each 5 mg/kg and the second dose follows the first dose by 2 weeks. In some embodiments, the first dose and the second dose are each 7.5 mg/kg and the second dose follows the first dose by 3 weeks.

For treating diseases, disorders or conditions, the antibody in some embodiments is administered via intravenous infusion. The dosage administered via infusion is in the range of about 1 µg/m$^2$ to about 10,000 µg/m$^2$ per dose, generally one dose per week for a total of one, two, three or four doses. Alternatively, the dosage range is of about 1 µg/m$^2$ to about 1000 µg/m$^2$, about 1 µg/m$^2$ to about 800 µg/m$^2$, about 1 µg/m$^2$ to about 600 µg/m$^2$, about 1 µg/m$^2$ to about 400 µg/m$^2$; alternatively, about 10 µg/m$^2$ to about 500 µg/m$^2$, about 10 µg/m$^2$ to about 300 µg/m$^2$, about 10 µg/m$^2$ to about 200 µg/m$^2$, and about 1 µg/m$^2$ to about 200 µg/m$^2$. The dose may be administered once per day, once per week, multiple times per week, but less than once per day, multiple times per month but less than once per day, multiple times per month but less than once per week, once per month or intermittently to relieve or alleviate symptoms of the disease, disorder, or condition. Administration may continue at any of the disclosed intervals until amelioration of the disease, disorder or condition, or amelioration of symptoms of the disease, disorder or condition being treated. Administration may continue after remission or relief of symptoms is achieved where such remission or relief is prolonged by such continued administration.

In one aspect, the present disclosure further provides pharmaceutical formulations comprising at least one anti-GFRAL antibody of the present disclosure. In some embodiments, a pharmaceutical formulation comprises 1) an anti-GFRAL antibody, and 2) a pharmaceutically acceptable carrier. In some embodiments, a pharmaceutical formulation comprises 1) an anti-GFRAL antibody and/or an immunoconjugate thereof, and optionally, 2) at least one additional therapeutic agent.

Pharmaceutical formulations comprising an antibody is prepared for storage by mixing the antibody having the desired degree of purity with optional physiologically acceptable carriers, excipients or stabilizers (see, e.g., Remington's Pharmaceutical Sciences 16th edition, Osol, A. Ed. (1980)) in the form of aqueous solutions or lyophilized or other dried formulations. The formulations herein may also contain more than one active compound as necessary for the particular disease, disorder or condition (e.g., a particular indication) being treated, preferably those with complementary activities that do not adversely affect each other. For example, in addition to an anti-GFRAL antibody, it may be desirable to include in the one formulation, an additional antibody, e.g., a second anti-GFRAL antibody which binds a different epitope on the GFRAL polypeptide, or an antibody to some other target. Alternatively, or additionally, the composition may further comprise another agent, including, for example, a chemotherapeutic agent, cytotoxic agent, cytokine, growth inhibitory agent, anti-hormonal agent, and/or cardioprotectant. In some embodiments the formulation includes an alkylating agent (e.g., chlorambucil, bendamustine hydrochloride or cyclophosphamide) a nucleoside analog (e.g., fludurabine, pentostatin, cladribine or cytarabine) a corticosteroid (e.g., prednisone, prednisolone or methylprednisolone), an immunomodulatory agent (e.g., lenalidomide), an antibiotic (e.g., doxorubicin, daunorubicin idarubicin or mitoxentrone), a synthetic flavon (e.g., flavopiridol), a Bcl2 antagonist, (e.g., oblimersen or ABT-263), a hypomethylating agent (e.g., azacytidine or decitabine), an FLT3 inhibitor (e.g., midostaurin, sorafenib and AC220). Such molecules are suitably present in combination in amounts that are effective for the purpose intended.

The antibodies of the present disclosure may be formulated in any suitable form for delivery to a target cell/tissue, for example, as microcapsules or macroemulsions (Remington's *Pharmaceutical Sciences,* 16th edition, Osol, A. Ed. (1980); Park et al., *Molecules* 10: 146-161 (2005); Malik et al., *Curr. Drug. Deliv.* 4: 141-151 (2007)); as sustained release formulations (Putney and Burke, *Nature Biotechnol.* 16: 153-157, (1998)) or in liposomes (Maclean et al., *Int. J. Oncol.* 11: 235-332 (1997); Kontermann, *Curr. Opin. Mol. Ther.* 8: 39-45 (2006)).

An antibody provided herein can also be entrapped in microcapsule prepared, for example, by coacervation techniques or by interfacial polymerization, for example, hydroxymethylcellulose or gelatin-microcapsule and poly-(methylmethacylate) microcapsule, respectively, in colloidal drug delivery systems (for example, liposomes, albumin microspheres, microemulsions, nano-particles and nanocapsules) or in macroemulsions. Such techniques are disclosed, for example, in Remington's Pharmaceutical Sciences (1990) Mack Publishing Co., Easton, Pa.

Various delivery systems are known and can be used to administer a prophylactic or therapeutic agent (e.g., an antibody that binds to GFRAL as described herein), including, but not limited to, encapsulation in liposomes, microparticles, microcapsules, recombinant cells capable of expressing the antibody, receptor-mediated endocytosis (see, e.g., Wu and Wu, J. Biol. Chem. 262:4429-4432 (1987)), construction of a nucleic acid as part of a retroviral or other vector, etc. In another embodiment, a prophylactic or therapeutic agent, or a composition provided herein can be delivered in a controlled release or sustained release system. In one embodiment, a pump may be used to achieve controlled or sustained release (see, e.g., Langer, supra; Sefton, 1987, CRC Crit. Ref. Biomed. Eng. 14:20; Buchwald et al., 1980, Surgery 88:507; Saudek et al., 1989, N. Engl. J. Med. 321:574). In another embodiment, polymeric materials can be used to achieve controlled or sustained release of a prophylactic or therapeutic agent (e.g., an antibody that binds to GFRAL as described herein) or a composition of the invention (see, e.g., Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas, 1983, J., Macromol. Sci. Rev. Macromol. Chem. 23:61; see also Levy et al., 1985, Science 228:190; During et al., 1989, Ann. Neurol. 25:351; Howard et al., 1989, J. Neurosurg. 7 1:105); U.S. Pat. No. 5,679,377; U.S. Pat. No. 5,916,597; U.S. Pat. No. 5,912,015; U.S. Pat. No. 5,989,463; U.S. Pat. No. 5,128,326; PCT Publication No. WO 99/15154; and PCT Publication No. WO 99/20253). Examples of polymers used in sustained release formulations include, but are not limited to, poly(2-hydroxy ethyl methacrylate), poly(methyl methacrylate), poly(acrylic acid), poly(ethylene-co-vinyl acetate), poly(methacrylic acid), polyglycolides (PLG), polyanhydrides, poly(N-vinyl pyrrolidone), poly(vinyl alcohol), polyacrylamide, poly(ethylene glycol), polylactides (PLA), poly(lactide-co-glycolides) (PLGA), and polyorthoesters. In one embodiment, the polymer used in a sustained release formulation is inert, free of leachable impurities, stable on storage, sterile, and biodegradable.

In yet another embodiment, a controlled or sustained release system can be placed in proximity of the therapeutic target, for example, the nasal passages or lungs, thus requiring only a fraction of the systemic dose (see, e.g., Goodson, in Medical Applications of Controlled Release, supra, vol. 2, pp. 115-138 (1984)). Controlled release systems are discussed, for example, by Langer (1990, Science 249:1527-1533). Any technique known to one of skill in the art can be used to produce sustained release formulations comprising one or more antibodies that bind to GFRAL as described herein. (See, e.g., U.S. Pat. No. 4,526,938, PCT publication WO 91/05548, PCT publication WO 96/20698, Ning et al., 1996, "Intratumoral Radioimmunotherapy of a Human Colon Cancer Xenograft Using a Sustained-Release Gel," Radiotherapy & Oncology 39:179-189, Song et al., 1995, "Antibody Mediated Lung Targeting of Long-Circulating Emulsions," PDA Journal of Pharmaceutical Science & Technology 50:372-397, Cleek et al., 1997, "Biodegradable Polymeric Carriers for a bFGF Antibody for Cardiovascular Application," Pro. Intl. Symp. Control. Rel. Bioact. Mater. 24:853-854, and Lam et al., 1997, "Microencapsulation of Recombinant Humanized Monoclonal Antibody for Local Delivery," Proc. Intl. Symp. Control Rel. Bioact. Mater. 24:759-760).

Additional delivery systems can be used to administer a prophylactic or therapeutic agent (e.g., an antibody that binds to GFRAL as described herein) including, but not limited to, injectable drug delivery devices. Injectable drug delivery devices for anti-GFRAL antibodies include, for example, hand-held devices or wearable devices. Hand-held devices useful for anti-GFRAL antibodies include autoinjectors, such as the FLEXIQ-DV (Elcam Medical) or PRO- JECT (Aptar Pharma) autoinjectors. Wearable devices useful for anti-GFRAL antibodies include, for example, on-body drug delivery systems, such as the NEULASTA drug delivery kit (Amgen). Injectable drug delivery devices for anti-GFRAL antibodies can contain the antibody as a prophyactic or therapeutic agent, for example, in prefilled syringes, cartridges or vials. Injectable drug delivery devices (e.g., autoinjectors) and/or their containers (e.g., syringes, cartridges or vials) for anti-GFRAL antibodies can be disposable. Exemplary injectable devices useful for anti-GFRAL antibodies are described in WO2014/081780.

In some embodiments, additional drug delivery systems can be used to administer a prophylactic or therapeutic agent (e.g., an antibody that binds to GFRAL as described herein) including, but not limited to, osmotic pumps. Different types of osmotic pump systems for anti-GFRAL antibodies can be used, including, for example, single compartment systems, dual compartment systems, and multiple compartment systems. Exemplary osmotic pump systems useful for anti-GFRAL antibodies are described, for example, in Herrlich et al. (2012) Advanced Drug Delivery Reviews 64, 1617-1627. In some embodiments, the osmotic pump for anti-GFRAL antibodies can include implantable drug-dispensing osmotic pumps such as the DUROS pump.

Therapeutic Methods

An anti-GFRAL antibody of the present disclosure may be used in, for example, therapeutic methods.

In some embodiments, the present disclosure provides methods for treating or preventing a GDF15-mediated disease, disorder, or condition, wherein the method comprises administering an anti-GFRAL antibody or fragment thereof described herein to a subject suffering from a GDF15-mediated disease, disorder or condition. Additionally, the subject can be administered a pharmaceutical composition comprising an anti-GFRAL antibody or fragment thereof described herein.

In some embodiments, present disclosure provides a method to treat a subject suffering from involuntary weight loss. An example of a suitable subject may be one who is diagnosed with a wasting disease or cachexia. Suitable patients include those suffering from liver cirrhosis, hyperthyroidism, chronic kidney disease, Parkinson's disease, cancer, eating disorder (e.g., anorexia nervosa), chronic inflammatory disease (e.g., rheumatoid arthritis), sepsis or other forms of systemic inflammation, chronic obstructive pulmonary disease, AIDS, tuberculosis, and muscle wasting, such as muscular dystrophy or multiple sclerosis), or sarcopenia.

In some embodiments, the present disclosure also provides methods for preventing involuntary weight loss in a subject who may be at risk of involuntary weight loss due to a chronic disease, such as, liver cirrhosis, hyperthyroidism, chronic kidney disease, Parkinson's disease, cancer, eating disorder (e.g., anorexia nervosa), chronic inflammatory disease (e.g., rheumatoid arthritis), sepsis or other forms of systemic inflammation, chronic obstructive pulmonary disease, AIDS, tuberculosis, and muscle wasting, such as muscular dystrophy or multiple sclerosis), or sarcopenia. Such subjects may include subjects who have elevated levels of GDF15, are undergoing treatment for cancer, and the like.

In some embodiments, the present disclosure provides a method to treat a subject suffering from cachexia. An example of a suitable subject is one who is diagnosed with cachexia. The present disclosure also provides methods for preventing involuntary weight loss in a subject who may be at risk of involuntary weight loss due to onset of cachexia. Such subjects include subjects who have elevated levels of GDF15, have cancer, are undergoing treatment for cancer, have an eating disorder, and the like.

Also disclosed is a method for modulating GDF15 activity in a patient having elevated GDF15 activity. As used herein, "elevated GDF15 activity" refers to increased activity or amount of GDF15 in a biological fluid of a subject in comparison to a normal subject. A number of conditions are associated with increased GDF15 serum level, wherein the increased GDF15 results in a number of symptoms such as appetite loss, weight loss, and the like. Examples of conditions associated with increased GDF15 serum level include cancer, e.g., melanoma, gastric cancer, pancreatic cancer, prostate cancer; autoimmune diseases such as, arthritis and inflammation; cardiovascular diseases like atherosclerosis, heart failure, hypertension, myocardial infarction, chest pain, and cardiovascular events; metabolic diseases like anemia, cachexia, anorexia, kidney disease, and thalassemia, etc.

A subject having any of the above diseases, disorders or conditions is a suitable candidate for receiving an anti-GFRAL antibody or fragment thereof described herein, or a combination of a therapeutic agent and the anti-GFRAL antibody or fragment thereof.

Administering the subject an anti-GFRAL antibody or fragment thereof to such a subject can decrease or prevent one or more of the symptoms associated with a GDF15-mediated disease, disorder or condition. For example, administering an anti-GFRAL antibody or fragment thereof of the present disclosure can increase body weight and/or appetite in a subject. As another example, administering an anti-GFRAL antibody or fragment thereof of the present disclosure can maintain body weight in a subject or reduce body weight loss is a subject.

In one aspect, methods are provided for treating a disease, disorder or condition comprising administering to an individual an effective amount of an anti-GFRAL antibody or fragment thereof. In certain embodiments, a method for treating a disease, disorder, or condition comprises administering to an individual an effective amount of a pharmaceutical formulation comprising an anti-GFRAL antibody and, optionally, at least one additional therapeutic agent, such as those described herein.

An anti-GFRAL antibody or fragment thereof can be administered to a human for therapeutic purposes. Moreover, an anti-GFRAL antibody or fragment thereof can be administered to a non-human mammal expressing GFRAL with which the antibody cross-reacts (e.g., a primate, pig, rat, or mouse) for veterinary purposes or as an animal model of human disease. Regarding the latter, such animal models may be useful for evaluating the therapeutic efficacy of antibodies of the present disclosure (e.g., testing of dosages and time courses of administration).

Antibodies of the present disclosure can be used either alone or in combination with other compositions in a therapy. For example, an anti-GFRAL antibody of the present disclosure may be co-administered with at least one additional therapeutic agent and/or adjuvant. In some embodiments, the additional compound is a therapeutic antibody other than an anti-GFRAL antibody.

Such combination therapies noted above encompass combined administration (where two or more therapeutic agents are included in the same or separate formulations), and separate administration, in which case, administration of an anti-GFRAL antibody or fragment thereof of the present disclosure can occur prior to, simultaneously, and/or following, administration of the additional therapeutic agent and/or adjuvant. Antibodies of the present disclosure can also be used in combination with additional therapeutic regimens including, without limitation, those described herein.

An anti-GFRAL antibody of the present disclosure (and any additional therapeutic agent or adjuvant) can be administered by any suitable means, including parenteral, subcutaneous, intraperitoneal, intrapulmonary, and intranasal, and, if desired for local treatment, intralesional administration. Parenteral infusions include intramuscular, intravenous, intraarterial, intraperitoneal, or subcutaneous administration. In addition, the antibody or conjugate is suitably administered by pulse infusion, particularly with declining doses of the antibody or fragment thereof. Dosing can be by any suitable route, for example, by injections, such as intravenous or subcutaneous injections, depending in part on whether the administration is brief or chronic.

Antibodies of the present disclosure would be formulated, dosed, and administered in a fashion consistent with good medical practice. Factors for consideration in this context include the particular disorder being treated, the particular mammal being treated, the clinical condition of the individual subject, the cause of the disorder, the site of delivery of the agent, the method of administration, the scheduling of administration, and other factors known to medical practitioners. The anti-GFRAL antibody need not be, but is optionally formulated with one or more agents currently used to prevent or treat the disorder in question. The effective amount of such other agents depends on the amount of antibody or immunoconjugate present in the formulation, the type of disorder or treatment, and other factors discussed above. These are generally used in the same dosages and with administration routes as described herein, or about from 1 to 99% of the dosages described herein, or in any dosage and by any route that is empirically/clinically determined to be appropriate.

For the prevention or treatment of a disease, disorder, or condition, the appropriate dosage of an anti-GFRAL antibody or fragment thereof of the present disclosure (when used alone or in combination with one or more other additional therapeutic agents, such as agents described herein) will depend on the type of disease, disorder, or condition, to be treated, the type of antibody, the severity and course of the disease, disorder, or condition, whether the antibody is administered for preventive or therapeutic purposes, previous therapy, the subject's clinical history and response to the antibody, and the discretion of the attending physician. The anti-GFRAL antibody or fragment thereof is suitably administered to the subject at one time or over a series of treatments. Depending on the type and severity of the disease, about 1 µg/kg to 100 mg/kg (e.g., 0.1 mg/kg-20 mg/kg, 1 mg/kg-15 mg/kg, etc.) of antibody or fragment thereof can be an initial candidate dosage for administration to the subject, whether, for example, by one or more separate administrations, or by continuous infusion. One typical daily dosage might range from about 1 µg/kg to 100 mg/kg or more, depending on the factors mentioned above. For repeated administrations over several days or longer, depending on the condition, the treatment would generally be sustained until a desired suppression of disease symptoms occurs. Exemplary dosages of the antibody or fragment thereof may be in the range from about 0.05 mg/kg to about 10.0 mg/kg. Thus, one or more doses of about 0.5 mg/kg, 1.0 mg/kg, 2.0 mg/kg, 3.0 mg/kg, 4.0 mg/kg, 5.0 mg/kg, 6.0 mg/kg, 7.0 mg/kg, 8.0 mg/kg, 9.0 mg/kg, or 10.0 mg/kg (or any combination thereof) of antibody may be administered to the subject. Such doses may be administered intermittently, e.g., every week or every three weeks (e.g., such that the subject receives from about two to about twenty, or e.g., about six doses of the antibody). An initial higher loading dose, followed by one or more lower doses may be administered. An exemplary dosing regimen comprises administering an initial loading dose, followed by a maintenance dose (e.g., weekly) of the antibody or fragment thereof. The initial loading dose may be greater than the maintenance dose. However, other dosage regimens may be useful. The progress of this therapy is easily monitored by conventional techniques and assays.

In some embodiments, the method described herein involves administering the subject an anti-GFRAL antibody or fragment thereof to a patient who has involuntary body weight loss or is at risk of developing involuntary body weight loss. The subject methods include administering an anti-GFRAL antibody or fragment thereof disclosed herein to a subject who has elevated serum levels of GDF15. In certain embodiment, the antibody or fragment thereof is an anti-GFRAL antibody that competes with GDF15 for binding to extracellular domain of GFRAL. In certain embodiments, the antibody or fragment thereof binds to an extracellular domain of a GFRAL protein but does not activate RET. For example, the antibody or fragment thereof is an anti-GFRAL antibody that competes with GDF15 for binding to extracellular domain of GFRAL but does not activate RET upon binding to GFRAL. Such an antibody is described herein.

In the methods of the present disclosure, anti-GFRAL antibodies or fragments thereof described herein or pharmaceutical compositions comprising said antibodies or fragments thereof can be administered to a subject (e.g., a human patient) to, for example, achieve a target body weight and/or maintain body weight; achieve a target body mass index (BMI) and/or maintain a BMI; increase appetite; and the like. A normal human adult has a BMI in the range 18.5-24.9 $Kg/m^2$. The subject treatment methods can increase body weight, BMI, muscle weight, and/or food intake in a patient by at least about 5%, e.g., 10%, 15%, 20%, 25%, 30%, 35%, 40%, 45%, 50% or more.

The methods relating to treatment or prevention of a GDF15-mediated disease, disorder or condition (e.g., involuntary weight loss) described herein include, for example, use of an anti-GFRAL antibody or fragment thereof described herein for therapy/prevention alone or in combination with other types of therapy. The method involves administering to a subject the anti-GFRAL antibody or fragment thereof and another agent.

In some embodiments, the agent is administered to a patient experiencing loss of muscle mass, for example, loss of muscle mass associated with an underlying disease. Underlying diseases associated with cachexia include, but are not limited to, cancer, chronic renal disease, chronic obstructive pulmonary disease, AIDS, tuberculosis, chronic inflammatory diseases, sepsis and other forms of systemic inflammation, muscle wasting, such as muscular dystrophy, and the eating disorder known as anorexia nervosa. In some embodiments, the agent inhibits loss of lean mass (e.g., muscle mass) and or fat mass by at least 40%, 50%, 60%, 70%, 80%, 90%, 95%, 98%, 99%, or 100%.

In some embodiments, a loss of lean mass (e.g., muscle mass) is accompanied by a loss of fat mass. In some embodiments, the agent can inhibit loss of fat mass by at least 40%, 50%, 60%, 70%, 80%, 90%, 95%, 98%, 99%, or 100%.

In some embodiments, the agent is administered to a patient diagnosed with body weight loss (e.g., involuntary weight loss). In some embodiments, the agent can revert body weight loss (e.g., involuntary weight loss) by at least 2%, 5%, 10%, 15%, 20%, 25%, 30% or 35%.

In some embodiments, the agent is administered to a patient diagnosed with loss of organ mass, for example, loss of organ mass associated with an underlying disease. Underlying diseases associated with cachexia include, but are not limited to, cancer, chronic renal disease, chronic obstructive pulmonary disease, AIDS, tuberculosis, chronic inflammatory diseases, sepsis and other forms of systemic inflammation, muscle wasting, such as muscular dystrophy, and the eating disorder known as anorexia nervosa. In some embodiments, the agent can inhibit loss of organ mass by at least 40%, 50%, 60%, 70%, 80%, 90%, 95%, 98%, 99%, or 100%. In some embodiments, loss of organ mass is observed in heart, liver, kidney, and/or spleen. In some embodiments, the loss of organ mass in accompanied by a loss of muscle mass, a loss of fat mass and/or involuntary weight loss.

Sarcopenia, muscle wasting disorders and significant muscle weight loss can occur in the absence of cachexia, decreased appetite or body weight loss. In some embodiments, the agent can be used to treat a subject diagnosed with sarcopenia, a muscle wasting disorder and/or significant muscle weight loss, whether or not the subject has, or has been diagnosed with, cachexia or decreased appetite. Such a method comprises administering a therapeutically effective amount of one or more agents to a subject in need thereof.

Any of a wide variety of therapies directed to treating or preventing cachexia can be combined in a composition or therapeutic method with the subject proteins.

Where the GFRAL-ECD protein is administered in combination with one or more other therapies, the combination can be administered anywhere from simultaneously to up to 5 hours or more, e.g., 10 hours, 15 hours, 20 hours or more, prior to or after administration of a subject protein. In certain embodiments, a subject protein and other therapeutic intervention are administered or applied sequentially, e.g., where a subject protein is administered before or after another therapeutic treatment. In yet other embodiments, a subject protein and other therapy are administered simultaneously, e.g., where a subject protein and a second therapy are administered at the same time, e.g., when the second therapy is a drug it can be administered along with a subject protein as two separate formulations or combined into a single composition that is administered to the subject. Regardless of whether administered sequentially or simultaneously, as illustrated above, the treatments are considered to be administered together or in combination for purposes of the present disclosure.

Cytokines that are implicated in cachexia include Activin A and IL-6. Increased activin levels have been associated with cancer-associated cachexia and gonadal tumors. See, e.g., Marino et al. (2013) CYTOKINE & GROWTH FACTOR REV. 24:477-484. Activin A is a member of the TGF-beta family, and is a ligand of the activin type 2 receptor, ActRIIB. See, e.g., Zhou et al. (2010) CELL 142:531-543. Circulating levels of IL-6 have been shown to correlate with weight loss in cancer patients, as well as with reduced survival. See, e.g., Fearon et al. (2012) CELL METABOLISM 16: 153-166.

Accordingly, in some embodiments, one or more inhibitors of Activin-A or the Activin-A receptor, ActRIIB, IL-6 or the IL-6 receptor (IL-6R), can be administered in combination with (for example, administered at the same time as, administered before, or administered after) an anti-GFRAL antibody or fragment thereof described herein. Exemplary inhibitors of Activin A or ActRIIB, include, for example, an anti-Activin-A antibody or an antigen binding fragment thereof, an anti-ActRIIB antibody or an antigen binding fragment thereof, a small molecule inhibitor of Activin-A, a small molecule inhibitor of ActRIIB, and a 'decoy' receptor of ActRIIB, such as a soluble ActRIIB receptor and a fusion of the soluble ActRIIB receptor with an Fc molecule (ActRIIB-Fc). See, e.g., Zhou et al. (2010), supra. Suitable inhibitors of IL-6 or IL-6R, include an anti-IL-6 antibody or an antigen binding fragment thereof, an anti-IL-6R antibody or an antigen binding fragment thereof, a small molecule inhibitor of IL-6, a small molecule inhibitor of IL-6R, and a 'decoy' receptor of IL-6R, such as a soluble IL-6 receptor and a fusion of the soluble IL-6 receptor with an Fc molecule (IL6R-Fc). See, e.g., Enomoto et al. (2004) BIOCHEM. AND BIOPHYS. RES. COMM. 323: 1096-1 102; Argiles et al. (2011) EUR. J. PHARMACOL. 668:S81-S86; Tuca et al. (2013) ONCOLOGY/HEMATOLOGY 88:625-636. Suitable inhibitors of IL-6 or IL-6R can include, e.g., Tocilizumab (Actemra®, Hoffmann-LaRoche), a humanized anti-IL-6R monoclonal antibody approved for treatment of rheumatoid arthritis, and Sarilumab/REGN88 (Regeneron), a humanized anti-IL6R antibody in clinical development for treatment of rheumatoid arthritis; and Selumetinib/AZD6244 (AstraZeneca), an allosteric inhibitor of MEK, which has been shown to inhibit IL-6 production. Prado et al. (2012) BRITISH J. CANCER 106: 1583-1586.

TNFα and IL-1 are cytokines known to be involved in mediation of the proinflammatory response, which are also implicated in muscle depletion, anorexia and cachexia. Increased circulating levels of TNFα appear to inhibit myogenesis. TNFα, also known as "cachectin," stimulates interleukin-1 secretion and is implicated in the induction of cachexia. IL-1 is a potent trigger of the acute-phase inflammatory response, and it has been shown that infusion of IL-1 can lead to marked weight loss and appetite loss. IL-1 has been shown to contribute to the initiation of cancer cachexia in mice bearing a murine colon-26 adenocarcinoma (Strassmann et al. (1993) J. IMMUNOL. 150:2341). See also, Mathys and Billiau (1997) NUTRITION 13:763-770; Fong et al. (1989) AM. J. PHYSIOL.—REGULATORY, INTEGRATIVE AND COMPARATIVE PHYSIOL., 256:R659-R665. Thus, TNFα inhibitors and IL-1 inhibitors that are used in the treatment of rheumatoid arthritis may also be useful in the treatment of cachexia.

Accordingly, in some embodiments, one or more inhibitors of TNFα or IL-1 can be administered in combination with (e.g., administered at the same time as, administered before, or administered after) an anti-GFRAL antibody or fragment thereof described herein. Suitable inhibitors of TNFα or IL-1 include an anti-TNFα antibody or an antigen binding fragment thereof, an anti-IL-1 antibody or an antigen binding fragment thereof, a small molecule inhibitor of TNFα or IL-1, and a 'decoy' receptor of TNFα or IL-1, such as a soluble TNFα or IL-1 receptor and a fusion of the soluble form of TNFα or IL-1 with an Fc molecule. Suitable inhibitors of TNFα include for example, etanercept (Enbrel®, Pfizer/Amgen), infliximab (Remicade®, Janssen Biotech), adalimumab (Humira®, Abbvie), golimumab (Simponi®, Johnson and Johnson/Merck), and certolizumab pegol (Cimzia®, UCB). Suitable IL-1 inhibitors include, e.g., Xilonix® antibody that targets IL-1 a (XBiotech), anikinra (Kinaret®, Amgen), canakinumab (Ilaris®, Novartis), and rilonacept (Arcalyst®, Regeneron). In certain embodiments, the TNFα inhibitor or IL-1 inhibitor, which is typically administered systemically for the treatment of rheumatoid arthritis may be administered locally and directly to the tumor site.

Myostatin, also known as GDF-8, is a member of the TGF-β family of peptides that is a negative regulator of muscle mass, as shown by increased muscle mass in myostatin deficient mammals. Myostatin is a ligand of the activin type 2 receptor, ActRIIB.

Accordingly, in some embodiments, one or more inhibitors of myostatin or its receptor may be administered in combination with (for example, administered at the same time as, administered before, or administered after) an anti-GFRAL antibody or fragment thereof described herein. Suitable inhibitors of myostatin or ActRIIB, include an anti-myostatin antibody or an antigen binding fragment thereof, an anti-ActRIIB antibody or an antigen binding fragment thereof, a small molecule inhibitor of myostatin, a small molecule inhibitor of ActRIIB, and a 'decoy' receptor of GDF-8, such as a soluble ActRIIB and a fusion of the soluble form of ActRIIB with an Fc molecule. See, e.g., Lokireddy et al. (2012) BIOCHEM. J. 446(I):23-26. Myostatin inhibitors that may be suitable for the present methods include REGN1033 (Regeneron); see Bauerlein et al. (2013) J. CACHEXIA SARCOPENIA MUSCLE: Abstracts of the 7th Cachexia Conference, Kobe/Osaka, Japan, Dec. 9-11, 2013, Abstract 4-06; LY2495655 (Lilly), a humanized anti-myostatin antibody in clinical development by Eli Lilly; see also "A PHASE 2 STUDY OF LY2495655 IN PARTICIPANTS WITH PANCREATIC CANCER," available on the world wide web at clinicaltrials.gov/ct2/NCT01505530; NML identifier: NCT01505530; ACE-031 (Acceleron Pharma); and stamulumab (Pfizer).

Agents such as Ghrelin or ghrelin mimetics, or other growth hormone secretagogues (GHS) which are able to activate the GHS receptor (GHS-RIa), also known as the ghrelin receptor, can be useful for increasing food intake and body weight in humans. See Guillory et al. (2013) in VITAMINS AND HORMONES vol. 92, chap. 3; and Steinman and DeBoer (2013) VITAMINS AND HORMONES vol. 92, chap. 8. Accordingly, in some embodiments, one or more Ghrelin or ghrelin mimetics, or other growth hormone secretagogues (GHS), can be administered in combination with (for example, administered at the same time as, administered before, or administered after) an anti-GFRAL antibody or fragment thereof described herein. Suitable ghrelin mimetics include anamorelin (Helsinn, Lugano, CH); see Temel et al. (2013) J. CACHEXIA SARCOPENIA MUSCLE: Abstracts of the 7th Cachexia Conference, Kobe/Osaka, Japan, Dec. 9-11, 2013, Abstract 5-01. Other suitable GHS molecules can be identified, for example, using the growth hormone secretagogue receptor Ghrelin competition assay described in PCT Publication Nos. WO201 1/1 17254 and WO2012/1 13103.

Agonists of the androgen receptor, including small molecules and other selective androgen receptor modulators (SARMs) can be useful in treating cachexia and/or sarcopenia. See, e.g., Mohler et al. (2009) J. MED. CHEM. 52:3597-3617; Nagata et al. (2011) BIOORGANIC AND MED. CHEM. LETTERS 21: 1744-1747; and Chen et al. (2005) MOL. INTERV. 5: 173-188. Ideally, SARMs should act as full agonists, like testosterone, in anabolic target tissues, such as muscle and bone, but should demonstrate only partial or pure androgen receptor antagonistic activities on prostate tissue. See, e.g., Bovee et al. (2010) J. STEROID BIOCHEM. & MOL. BIOL. 118:85-92. Suitable SARMs can be identified, e.g., by use of the methods and assays described in Zhang et al. (2006) BIOORG. MED. CHEM. LETT. 16:5763-5766; and Zhang et al. (2007) BIOORG. MED. CHEM. LETT. 17:439-443.

Accordingly, in some embodiments, one or more androgen receptor agonists can be administered in combination with (for example, administered at the same time as, administered before, or administered after) an anti-GFRAL antibody or fragment thereof described herein. Suitable SARMs include, for example, GTx-024 (enobosarm, Ostarine®, GTx, Inc.), a SARM in phase II clinical development by GTx, Inc. See also, Dalton et al. (2011) J. CACHEXIA SARCOPENIA MUSCLE 2: 153-161. Other suitable SARMs include 2-(2,2,2)-trifluoroethyl-benzimidazoles (Ng et al. (2007) BIOORG. MED. CHEM. LETT. 17: 1784-1787) and JNJ-26146900 (Allan et al. (2007) J. STEROID BIOCHEM. & MOL. BIOL. 103:76-83).

β-adrenergic receptor blockers, or beta-blockers, have been studied for their effect on body weight in cachexia subjects, and have been associated with partial reversal of cachexia in patients with congestive heart failure. See, e.g., Hryniewicz et al. (2003) J. CARDIAC FAILURE 9:464-468. Beta-blocker MT-102 (PsiOxus Therapeutics, Ltd.) has been evaluated in a phase 2 clinical trial for subjects with cancer cachexia. See Coats et al. (2011) J. CACHEXIA SARCOPENIA MUSCLE 2:201-207. Accordingly, in some embodiments, one or more β-adrenergic receptor blockers, or beta-blockers, can be administered in combination with (for example, administered at the same time as, administered before, or administered after) an anti-GFRAL antibody or fragment thereof described herein.

Melanocortin receptor-knockout mice with a genetic defect in melanocortin signaling exhibit a phenotype opposite that of cachexia: increased appetite, increased lean body mass, and decreased metabolism. Thus, melanocortin antagonism has emerged as a potential treatment for cachexia associated with chronic disease (DeBoer and Marks (2006) TRENDS IN ENDOCRINOLOGY AND METABOLISM 17: 199-204).

Accordingly, in some embodiments, one or more inhibitors of a melanocortin peptide or a melanocortin receptor can be administered in combination (e.g., administered at the same time as, administered before, or administered after) with an anti-GFRAL antibody or fragment thereof described herein. Suitable inhibitors of melanocortins or melanocortin receptors include an anti-melanocortin peptide antibody or an antigen binding fragment thereof, an anti-melanocortin receptor antibody or an antigen binding fragment thereof, a small molecule inhibitor of a melanocortin peptide, a small molecule inhibitor of a melanocortin receptor, and a 'decoy' receptor of a melanocortin receptor, such as soluble melanocortin receptor and a fusion of a soluble melanocortin receptor with an Fc molecule. Suitable melacortin receptor inhibitors include, for example, the melanocortin receptor antagonist agouri-related peptide (AgRP(83-132)), which has been demonstrated to prevent cachexia-related symptoms in a mouse model of cancer-related cachexia (Joppa et al. (2007) PEPTIDES 28:636-642).

Anti-cancer agents, especially those that can cause cachexia and elevate GDF15 levels, such as cisplatin, can be used in methods of the present disclosure in combination with (for example, administered at the same time as, administered before, or administered after) an anti-GFRAL antibody or fragment thereof described herein. Many cancer patients are weakened by harsh courses of radio- and/or chemotherapy, which can limit the ability of the patient to tolerate such therapies, and hence restrict the dosage regimen. Certain cancer agents themselves, such as fluorouracil, adriamycin, methotrexate and cisplatin, can contribute to cachexia, for example by inducing severe gastrointestinal complications. See, e.g., Inui (2002) CANCER J. FOR CLINICIANS 52:72-91. By the methods of the present disclosure, in which an anti-cancer agent is administered in combination with an anti-GFRAL antibody of the disclosure, it is possible to decrease the incidence and/or severity of cachexia, and ultimately increase the maximum tolerated dose of such an anti-cancer agent. Accordingly, efficacy of treatment with anti-cancer agents that can cause cachexia can be improved by reducing the incidence of cachexia as a dose-limiting adverse effect, and by allowing administration of higher doses of a given anticancer agent.

Thus, provided herein are pharmaceutical compositions comprising an anti-GFRAL antibody or fragment thereof described herein in combination with an agent selected from the group consisting of an inhibitor of Activin-A, an inhibitor of ActRIIB, an inhibitor of IL-6 or an inhibitor of IL-6R, a ghrelin, a ghrelin mimetic or a GHS-RIa agonist, a SARM, a TNFα inhibitor, an IL-Iα inhibitor, a myostatin inhibitor, a beta-blocker, a melanocortin peptide inhibitor, a melanocortin receptor inhibitor, and an anti-cancer agent. The present disclosure also includes methods of treating, preventing or minimizing cachexia and/or sarcopenia in a mammal comprising administering to a mammal in need thereof a pharmaceutical composition or compositions comprising an effective amount of an anti-GFRAL antibody of the disclosure in combination with an effective amount of an inhibitor of Activin-A, an inhibitor of ActRIIB, an inhibitor of IL-6 or an inhibitor of IL-6R, a ghrelin, a ghrelin mimetic or a GHS-RIa agonist, a SARM, a TNFα inhibitor, an IL-Iα inhibitor, a myostatin inhibitor, a beta-blocker, a melanocortin peptide inhibitor, or a melanocortin receptor inhibitor.

In another aspect, provided herein is a method of inhibiting loss of muscle mass associated with an underlying disease comprising administering to a mammal in need thereof a pharmaceutical composition or compositions comprising an effective amount of an anti-GFRAL antibody or fragment thereof described herein in combination with an effective amount of an inhibitor of Activin-A, an inhibitor of ActRIIB, an inhibitor of IL-6 or an inhibitor of IL-6R, a ghrelin, a ghrelin mimetic or a GHS-RIa agonist, a SARM, a TNFα inhibitor, an IL-Iα inhibitor, a myostatin inhibitor, a beta-blocker, a melanocortin peptide inhibitor, or a melanocortin receptor inhibitor to prevent or reduce loss of muscle mass. The underlying disease can be selected from the group consisting of cancer, chronic heart failure, chronic kidney disease, chronic obstructive pulmonary disease, AIDS, multiple sclerosis, rheumatoid arthritis, sepsis, and tuberculosis. Additionally, in some embodiments, the loss of muscle mass is accompanied by a loss of fat mass.

In another aspect, provided herein is a method of inhibiting or reducing involuntary weight loss in a mammal comprising administering to a mammal in need thereof a pharmaceutical composition or pharmaceutical compositions comprising an effective amount of an anti-GFRAL antibody of the disclosure in combination with an effective amount of an inhibitor of Activin-A, an inhibitor of ActRIIB, an inhibitor of IL-6 or an inhibitor of IL-6R, a ghrelin, a ghrelin mimetic or a GHS-RIa agonist, a SARM, a TNFα inhibitor, a IL-Iα inhibitor, a myostatin inhibitor, a beta-blocker, a melanocortin peptide inhibitor, or a melanocortin receptor inhibitor.

Certain anti-cancer agents, such as cisplatin, have one or more undesirable adverse effects that involve causing or increasing one or more syndromes such as cachexia, sarcopenia, muscle wasting, bone wasting or involuntary body weight loss. Accordingly, in another aspect, provided herein is a method of treating cancer, while preventing, minimizing or reducing the occurrence, frequency or severity of cachexia, sarcopenia, or muscle wasting, bone wasting or involuntary loss of body weight in a mammal, comprising administering to a mammal in need thereof a pharmaceutical composition comprising an effective amount of an anti-GFRAL antibody or fragment thereof described herein in combination with one or more anti-cancer agents. In some embodiments, the method of treating cancer, while preventing, minimizing or reducing the occurrence, frequency or severity of cachexia, sarcopenia or muscle wasting, bone wasting or involuntary loss of body weight in a mammal, comprises administering to a mammal in need thereof a pharmaceutical composition comprising an effective amount of an anti-GFRAL antibody or fragment thereof described herein in combination with one or more anti-cancer agents known to cause or increase the occurrence, frequency or severity of cachexia, sarcopenia, or muscle wasting, bone wasting or involuntary loss of body weight in a mammal.

Diagnostic Methods and Methods of Detection

In one aspect, anti-GFRAL antibodies and fragments thereof of the present disclosure are useful for detecting the presence of GFRAL in a biological sample. Such anti-GFRAL antibodies can include those that bind to human GFRAL. The term "detecting" as used herein encompasses quantitative or qualitative detection. In certain embodiments, a biological sample comprises a cell or tissue.

In one aspect, the present disclosure provides a method of detecting the presence of GFRAL in a biological sample. In certain embodiments, the method comprises contacting the biological sample with an anti-GFRAL antibody under conditions permissive for binding of the anti-GFRAL antibody to GFRAL, and detecting whether a complex is formed between the anti-GFRAL antibody and GFRAL.

In one aspect, the present disclosure provides a method of diagnosing a disorder associated with expression of GFRAL. In certain embodiments, the method comprises contacting a test cell with an anti-GFRAL antibody; determining the level of expression (either quantitatively or qualitatively) of GFRAL by the test cell by detecting binding of the anti-GFRAL antibody to GFRAL; and comparing the level of expression of GFRAL by the test cell with the level of expression of GFRAL by a control cell (e.g., a normal cell of the same tissue origin as the test cell or a cell that expresses GFRAL at levels comparable to such a normal cell), wherein a higher level of expression of GFRAL by the test cell as compared to the control cell indicates the presence of a disorder associated with increased expression of GFRAL. In certain embodiments, the test cell is obtained from an individual suspected of having a disease, disorder or condition associated with expression of GDF15 and/or a disease, disorder or condition in which it is desirable to inhibit the in vivo effects of GDF15. In certain embodiments, the disease, disorder or condition is, for example, involuntary weight loss. Such exemplary diseases, disorders or conditions may be diagnosed using an anti-GFRAL antibody of the present disclosure.

In certain embodiments, a method of diagnosis or detection, such as those described above, comprises detecting binding of an anti-GFRAL antibody to GFRAL expressed on the surface of a cell or in a membrane preparation obtained from a cell expressing GFRAL on its surface. In certain embodiments, the method comprises contacting a cell with an anti-GFRAL antibody under conditions permissive for binding of the anti-GFRAL antibody to GFRAL, and detecting whether a complex is formed between the anti-GFRAL antibody and GFRAL on the cell surface. An exemplary assay for detecting binding of an anti-GFRAL antibody to GFRAL expressed GFRAL on the surface of a cell is a "FACS" assay.

Certain other methods can be used to detect binding of anti-GFRAL antibodies to GFRAL. Such methods include, but are not limited to, antigen-binding assays that are well known in the art, such as western blots, radioimmunoassays, ELISA (enzyme linked immunosorbent assay), "sandwich" immunoassays, immunoprecipitation assays, fluorescent immunoassays, protein A immunoassays, and immunohistochemistry (IHC).

In certain embodiments, anti-GFRAL antibodies are labeled. Labels include, but are not limited to, labels or moieties that are detected directly (such as fluorescent, chromophoric, electron-dense, chemiluminescent, and radioactive labels), as well as moieties, such as enzymes or ligands, that are detected indirectly, for example, through an enzymatic reaction or molecular interaction. Exemplary labels include, but are not limited to, the radioisotopes $^{32}$P, $^{14}$C, $^{125}$I, $^{3}$H, and $^{131}$I, fluorophores such as rare earth chelates or fluorescein and its derivatives, rhodamine and its derivatives, dansyl, umbelliferone, luceriferases, for example, firefly luciferase and bacterial luciferase (see, e.g., U.S. Pat. No. 4,737,456), luciferin, 2,3-dihydrophthalazinediones, horseradish peroxidase (HRP), alkaline phosphatase, β-galactosidase, glucoamylase, lysozyme, saccharide oxidases, e.g., glucose oxidase, galactose oxidase, and glucose-6-phosphate dehydrogenase, heterocyclic oxidases such as uricase and xanthine oxidase, coupled with an enzyme that employs hydrogen peroxide to oxidize a dye precursor such as HRP, lactoperoxidase, or microperoxidase, biotin/avidin, spin labels, bacteriophage labels, stable free radicals, and the like.

In certain embodiments, anti-GFRAL antibodies are immobilized on an insoluble matrix. Immobilization entails separating the anti-GFRAL antibody from any GFRAL that remains free in solution. This conventionally is accomplished by either insolubilizing the anti-GFRAL antibody before the assay procedure, as by adsorption to a water-insoluble matrix or surface (see, e.g., Bennich et al., U.S. Pat. No. 3,720,760), or by covalent coupling (for example, using glutaraldehyde cross-linking), or by insolubilizing the anti-GFRAL antibody after formation of a complex between the anti-GFRAL antibody and GFRAL, for example, by immunoprecipitation.

Any of the above embodiments of diagnosis or detection may be carried out using an immunoconjugate of the present disclosure in place of or in addition to an anti-GFRAL antibody.

Assays

Anti-GFRAL antibodies of the present disclosure may be characterized for their physical/chemical properties and/or biological activities by various assays known in the art.

1. Activity Assays

In one aspect, assays are provided for identifying anti-GFRAL antibodies thereof having biological activity. Biological activity can include, for example, assays which measure effects on glucose and/or lipid metabolism. For example, a blood glucose assay can be used. Blood glucose (e.g., in mouse tail snip or in a human blood sample) can be measured using ACCU-CHEK Active test strips read by ACCU-CHEK Active meter (Roche Diagnostics, Indianapolis, Ind.) following manufacturer's instruction. In addition, for example, a lipid profile assay can be used. Whole blood (e.g., from mouse tail snips or from a human blood sample) can be collected into plain capillary tubes (BD Clay Adams SurePrep, Becton Dickenson and Co. Sparks, Md.). Serum and blood cells can be separated by spinning the tubes in an Autocrit Ultra 3 (Becton Dickinson and Co. Sparks, Md.). Serum samples can be assayed for lipid profile (triglyceride, total cholesterol, HDL, and non-HDL) using Integra 400 Clinical Analyzer (Roche Diagnostics, Indianapolis, Ind.) following the manufacturer's instructions.

2. Binding Assays and Other Assays

In one aspect, an anti-GFRAL antibody is tested for its antigen binding activity. For example, in certain embodiments, an anti-GFRAL antibody is tested for its ability to bind to exogenous or endogenous GFRAL expressed on the surface of a cell. A FACS assay may be used for such testing.

A panel of monoclonal antibodies raised against GFRAL may be grouped based upon the epitopes they recognize, a process known as epitope binning. Epitope binning is typically carried out using competition assays, which evaluate an antibody's ability to bind to an antigen in the presence of another antibody. In an exemplary competition assay, immobilized GFRAL is incubated in a solution comprising a first labeled antibody that binds to GFRAL and a second unlabeled antibody that is being tested for its ability to compete with the first antibody for binding to GFRAL. The second antibody may be present in a hybridoma supernatant. As a control, immobilized GFRAL is incubated in a solution comprising the first labeled antibody but not the second unlabeled antibody. After incubation under conditions permissive for binding of the first antibody to GFRAL, excess unbound antibody is removed, and the amount of label associated with immobilized GFRAL is measured. If the amount of label associated with immobilized GFRAL is substantially reduced in the test sample relative to the control sample, then that indicates that the second antibody is competing with the first antibody for binding to GFRAL. In certain embodiments, immobilized GFRAL is present on the surface of a cell or in a membrane preparation obtained from a cell expressing GFRAL on its surface.

High-throughput methods of epitope binning are also known in the art (see, e.g., Jia et al., *J. Immunol. Methods* 2004, 288(1-2):91-98, describing a method of multiplexed competitive antibody binning for the characterization of monoclonal antibodies; and Miller et al., *J. Immunol. Methods* 2011, 365(1-2):118-25, describing epitope binning of murine monoclonal antibodies by a multiplexed pairing assay).

3. Epitope Mapping

Epitope mapping is the process of identifying the binding sites, or epitopes, of an antibody on its target protein antigen (e.g., epitopes of an anti-GFRAL antibody on GFRAL). Antibody epitopes may be linear epitopes or conformational epitopes. Linear epitopes are formed by a continuous sequence of amino acids in a protein. Conformational epitopes are formed of amino acids that are discontinuous in the protein sequence, but which are brought together upon folding of the protein into its three-dimensional structure.

A variety of methods are known in the art for mapping antibody epitopes on target protein antigens. These include mutagenesis methods, peptide scanning methods, display methods, methods involving and mass spectroscopy, and structural determination.

The site directed mutagenesis method involves targeted site-directed mutagenesis where critical amino acids are identified by systematically introducing substitutions along the protein sequence and then determining the effects of each substitution on antibody binding. This may be done by "alanine scanning mutagenesis," as described, for example, by Cunningham and Wells (1989) *Science* 244: 1081-1085, or some other form of point mutagenesis of amino acid residues in human GFRAL. Mutagenesis studies, however, may also reveal amino acid residues that are crucial to the overall three-dimensional structure of GFRAL but that are not directly involved in antibody-antigen contacts, and thus other methods may be necessary to confirm a functional epitope determined using this method.

Shotgun mutagenesis mapping utilizes a comprehensive plasmid-mutation library for the target gene, with each clone in the library bearing a unique amino acid mutation and the entire library covering every amino acid in the target protein. The clones that constitute the mutation library are individually arranged in microplates, expressed within living mammalian cells, and tested for immunoreactivity with antibodies of interest. Amino acids critical for antibody epitopes are identified by a loss of reactivity and are then mapped onto a protein structure to visualize epitopes. By automating the analysis, new epitope maps can be derived within days to weeks. Because it uses the native structure of proteins within mammalian cells, the technique allows both linear and conformational epitope structures to be mapped on complex proteins. (See, e.g., Paes et al., *J. Am. Chem. Soc.* 131(20): 6952-6954 (2009); Banik and Doranz, *Genetic Engineering and Biotechnology News* 3(2): 25-28 (2010)).

The epitope bound by an anti-GFRAL antibody may also be determined using peptide scanning methods. In peptide scanning, libraries of short peptide sequences from overlapping segments of the target protein, GFRAL, are tested for their ability to bind antibodies of interest. The peptides are synthesized and screened for binding, e.g., using ELISA or BIACORE, or on a chip, by any of the multiple methods for solid-phase screening (see, e.g., Reineke et al., *Curr. Opin. Biotechnol.* 12: 59-64, 2001) as in the "pepscan" methodology (see, e.g., WO 84/03564; WO 93/09872). Such peptide screening methods may not be capable of detecting some discontinuous functional epitopes, i.e. functional epitopes that involve amino acid residues that are not contiguous along the primary sequence of the GFRAL polypeptide chain.

A recently developed technology termed CLIPS (chemical linkage of peptides onto scaffolds) may be used to map conformational epitopes. The loose ends of the peptides are affixed onto synthetic scaffolds, so that the scaffolded peptide may be able to adopt the same spatial structure as the corresponding sequence in the intact protein. CLIPS technology is used to fix linear peptides into cyclic structures ('single-loop' format), and to bring together different parts of a protein binding site ('double-loop', 'triple-loop', etc. format), so as to create conformational epitopes that may be assayed for antibody binding (see, e.g., U.S. Pat. No. 7,972, 993).

The epitopes bound by anti-GFRAL antibodies of the present disclosure may also be mapped using display techniques, including, for example, phage display, microbial display, and ribosome/mRNA display as described above. In these methods, libraries of peptide fragments are displayed on the surface of the phage or cell. Epitopes are then mapped by screening antibodies against these fragments using selective binding assays. A number of computational tools have been developed which allow the prediction of conformational epitopes based upon linear affinity-selected peptides obtained using phage display (see, e.g., Mayrose et al., *Bioinformatics* 23: 3244-3246, 2007). Methods are also available for the detection of conformational epitopes by phage display. Microbial display systems may also be used to express properly folded antigenic fragments on the cell surface for identification of conformational epitopes (see, e.g., Cochran et al., *J. Immunol. Meth.* 287: 147-158, 2004; Rockberg et al., *Nature Methods* 5: 1039-1045, 2008).

Methods involving proteolysis and mass spectroscopy may also be used to determine antibody epitopes (see, e.g., Baerga-Ortiz et al., *Protein Sci.* 2002 June; 11(6): 1300-1308). In limited proteolysis, the antigen is cleaved by different proteases, in the presence and in the absence of the antibody, and the fragments are identified by mass spectrometry. The epitope is the region of the antigen that becomes protected from proteolysis upon binding of the antibody (see, e.g., Suckau et al., *Proc. Natl. Acad. Sci. USA* 87:9848-9852, 1990). Additional proteolysis based methods include, for example, selective chemical modification (see, e.g., Fiedler et al., *Bioconjugate Chemistry* 1998, 9(2): 236-234, 1998), epitope excision (see, e.g., Van de Water et al., *Clin. Immunol. Immunopathol.* 1997, 85(3): 229-235, 1997), and the recently developed method of hydrogen-deuterium (H/D) exchange (see, e.g., Flanagan, N., *Genetic Engineering and Biotechnology News* 3(2): 25-28, 2010).

The epitope bound by anti-GFRAL antibodies of the present disclosure may also be determined by structural methods, such as X-ray crystal structure determination (see, e.g., WO 2005/044853), molecular modeling and nuclear magnetic resonance (NMR) spectroscopy, including NMR determination of the H-D exchange rates of labile amide hydrogens when free and when bound in a complex with an antibody of interest (see, e.g., Zinn-Justin et al. (1992) *Biochemistry* 31:11335-11347; Zinn-Justin et al. (1993) *Biochemistry* 32:6884-6891).

Additional antibodies binding to the same epitope as an anti-GFRAL antibody of the present disclosure may be obtained, for example, by screening of antibodies raised against GFRAL o for binding to the epitope, by immunization of an animal with a peptide comprising a fragment of human GFRAL comprising the epitope sequence, or by selection of antibodies using phage display for binding to the epitope sequence. Antibodies that bind to the same functional epitope might be expected to exhibit similar biological activities, such as blocking a biological activity of GFRAL, and such activities can be confirmed by functional assays of the antibodies.

4. Additional Activity Assays

In one embodiment, an anti-GFRAL antibody of the present disclosure is an antagonist antibody that inhibits a biological activity of GFRAL. The anti-GFRAL antibodies of the present disclosure may be assayed to determine if they inhibit a biological activity of GFRAL.

In one aspect, purified anti-GFRAL antibodies can be further characterized by a series of assays including, but not limited to, N-terminal sequencing, amino acid analysis, non-denaturing size exclusion high pressure liquid chromatography (HPLC), mass spectrometry, ion exchange chromatography and papain digestion.

In one embodiment, the present disclosure contemplates an altered antibody that possesses some but not all effector functions, which make it a desirable candidate for many applications in which the half life of the antibody in vivo is important yet certain effector functions (such as complement and ADCC) are unnecessary or deleterious. In certain embodiments, the Fc activities of the antibody are measured to ensure that only the desired properties are maintained. In vitro and/or in vivo cytotoxicity assays can be conducted to confirm the reduction/depletion of CDC and/or ADCC activities. For example, Fc receptor (FcR) binding assays can be conducted to ensure that the antibody lacks FcγR binding (hence likely lacking ADCC activity), but retains FcRn binding ability. An in vitro assay to assess ADCC activity of a molecule of interest is described, for example, in U.S. Pat. No. 5,500,362 or 5,821,337. Useful effector cells for such assays include peripheral blood mononuclear cells (PBMC) and Natural Killer (NK) cells. Alternatively, or additionally, ADCC activity of the molecule of interest may be assessed in vivo, for example, in a animal model such as that disclosed in Clynes et al. PNAS (USA) 95:652-656 (1998). C1q binding assays may also be carried out to confirm that the antibody is unable to bind C1q and hence lacks CDC activity. To assess complement activation, a CDC assay, for example, as described in Gazzano-Santoro et al., J. Immunol. Methods 202:163 (1996), may be performed. FcRn binding and in vivo clearance/half life determinations can also be performed using methods known in the art.

Although the foregoing present disclosure has been described in some detail by way of illustration and example for purposes of clarity of understanding, the descriptions and examples should not be construed as limiting the scope of the present disclosure. The disclosures of all patent and scientific literatures cited herein are expressly incorporated in their entirety by reference.

EXAMPLES

The following are examples of methods and compositions of the present disclosure.

Example 1: Generation of Antibodies

Antibodies to a GFRALprotein were generated, for example, by immunizations of mice with cells expressing a GFRAL protein, co-expressing a RET protein and a GFRAL protein, or cross-linking of a GDF15 protein onto cells co-expressing a RETprotein and a GFRAL protein. Mice were also immunized with a GFRAL ECD, GDF15:GFRAL ECD complex and/or GFRAL ECD Fc fusion: RET ECD Fc fusion.

For example, the cells used for immunizations were prepared as follows. 293EXPI (Invitrogen) cells were transiently transfected with nucleic acid sequences encoding a GFRAL protein (SEQ ID NO: 1797) or co-transfected with nucleic acid sequences encoding a GFRAL protein and a RET protein (SEQ ID NOS: 1797 and 1813). Cells were analyzed for expression of GFRAL and RET by the respective specific antibodies by FACS. Cells were washed 2 times in PBS, pelleted by centrifugation and membrane preps were generated. 129/B6 or NZBW animals were immunized with membrane preps with adjuvants. Animals were boosted to induce a suitable titer. Titers were determined by ELISA and/or FACS. Single cell suspensions of lymphocytes were obtained from spleen and draining lymph nodes of animals with suitable titers. Cells were fused with SP2/0 myeloma cells at a ratio of 1:12 by electrofusion. Fused cells were plated into plates in the presence of HAT selection. After 10-14 days of culture, supernatants were collected and subjected to screening by cell imaging by CellnSight using GFRAL or GFRAL and RET overexpressing-293EXPI cells or by ELISA using GFRAL-Fc protein or RET and GFRAL Fc-heterodimers to confirm binding. Positive clones were further selected and subjected to subcloning.

In multiple campaigns of immunizations and fusions, over one-hundred thousand hybridoma clones were screened and more than two thousand clones were selected for GDF15-binding, cell-based GDF15-induced signaling and cell-based GDF15-independent signaling. Hundreds of clones (e.g., 250) were selected for additional study, including assays for binding affinity, domain mapping, and epitope specificity. Thousands of hybridoma supernatants were also tested in functional assays, including antagonistic and agonist activity assays. Hundreds of clones were purified for further testing.

Example 2: Screening and Selection of Antibodies

After 2 weeks of culture, hybridoma supernatants were screened for monoclonal antibodies binding to a GFRAL protein by cell imaging by CellnSight using GFRAL or GFRAL and RET overexpressing-293EXPI cells or by ELISA using GFRAL-Fc protein or RET and GFRAL Fc-heterodimers. Briefly, screening by cell imaging, 293EXPI cells were transiently transfected with nucleic acid sequences encoding GFRAL or co-transfected with nucleic acid sequences encoding GFRAL and RET. Transfected cells were plated onto 384-well plates with clear bottom. Media was replaced 24 hours post transfection. At 48 hrs, media was aspirated off the plates, hybridoma supernatants were added to the wells and incubated at room temperature for 30 mins. Then A647 anti-mouse Fc were added to the wells and incubated at room temperature for another 30 mins. Dapi positive cells were analyzed for a signal in the A647 channel and a positive A647 signal indicates GFRAL binders.

Briefly, screening by ELISA, GFRAL-Fc protein or RET and GFRAL Fc-heterodimers was captured by anti-human Fc reagents coated onto ELISA plates. Plates were blocked using PBS/1% BSA. 15 µL of hybridoma supernatants were added to the wells and incubated at room temperature for 1 hr. After 3 washes, 15 µL of HRP-anti-mouse Fc secondary were added to the wells and incubated at room temperature for 1 hr. After 3 washes, 15 µL of TMB were used to develop the plates. A positive signal indicates GFRAL binders.

From these assays, thousands of antibodies were identified as binders to GFRAL. These antibodies were subjected to further testing, which included assaying for binding affinity, domain mapping, epitope specificity, and agonistic and antagonistic function. Hundreds of antibodies were purified for further testing.

In addition, the binding affinity of antibodies to human and mouse GFRAL were measured. For example, antibodies were rank ordered based on their binding affinity to human GFRAL and mouse GFRAL by low resolution $K_D$ measurement by Biacore. Briefly, an anti-mouse Fc antibody (Sigma-Aldrich, St. Louis, Mo.) was immobilized on all four flow cells of a CM5 chip using amine coupling reagents (GE Healthcare LifeSciences, Piscataway, N.J.). Purified antibodies were captured (~100 RUs) on flow cells 2, 3 and 4 using flow cell 1 as a reference. This was followed by injection of human or mouse GFRAL (25 nM in PBS-P buffer) at a flow rate of 70 µL/m in and monitoring the binding kinetics at 25° C.

Binding affinity measurements were also made in additional Biacore based assays. For example, equilibrium dissociation constant ($K_D$) measurements were carried out with purified antibodies to evaluate their binding to human GFRAL or mouse GFRAL. As mentioned above, anti-mouse Fc antibody (Sigma-Aldrich, St. Louis, Mo.) was immobilized on all four flow cells of a CM5 chip using amine coupling reagents (GE Healthcare LifeSciences, Piscataway, N.J.). Purified antibodies were captured (~100 RUs) on flow cells 2, 3 and 4 using flow cell 1 as a reference. This was followed by injection of human or mouse GFRAL in PBS-P buffer) at a flow rate of 70 µL/min and the binding kinetics were evaluated at 25° C.

Representative results for binding affinity (e.g., $K_D$ (nM)) to human and mouse GFRAL are shown in Table 26 below. In addition, representative results for off-rate of binding (e.g., $K_{off}$ (1/s)) are shown in Table 26 below for exemplary antibodies.

TABLE 26

| | Binding Affinity | | | |
|---|---|---|---|---|
| | Human GFRAL | | Mouse GFRAL | |
| Clone ID | $K_D$ (nM) | $k_{off}$ (1/s) | $K_D$ (nM) | $k_{off}$ (1/s) |
| 1C1 | <0.1 | ~1E5 | 3.68 | 2.5E-3 |
| 25M22 | <0.1 | ~1E-5 | 4.2 | 1E-4 |
| 8D8 | 0.46 | 1.24E-4 | 8.17 | 2.81E-3 |
| 12A3 | <0.1 | ~1E-5 | 5.7 | 2.16E-3 |
| 3P10 | <0.1 | ~1E-5 | <0.1 | ~1E-5 |
| 5F12 | <0.1 | ~1E-5 | 2.2 | 9E-4 |
| 5A20 | 0.081 | 3.32E-5 | <0.1 | 4-E4 |
| 17J16 | <0.1 | ~1E-5 | <0.1 | 1E-5 |
| 6G9 | <0.1 | ~1E5 | No | N/A |
| 2B8 | 0.73 | ~1E5 | 3.76 | 1.3E-2 |
| 6N16 | 0.16 | 9.93E-5 | ND | NA |
| 8C10 | <0.1 | 7.2E-5 | weak | 49.26 |
| 2B11 | 0.1 | 8.45E-5 | 3.7 | 1.44E-3 |
| 1B3 | <0.1 | 9.4E-9 | 4.4 | 1.07E-3 |
| 19K19 | 0.21 | 1.35E-4 | 4.7 | 3.4E-3 |
| 22N5 | 0.21 | 1.32E-4 | 3.47 | 9.43E-4 |
| 2A9 | 0.25 | 1.53E-4 | 3.6 | 2.9E-3 |
| 24G2 | 1.4 | 6.96E-4 | 5.02 | 1.73E-3 |
| 2I23 | 0.23 | 6.77E-5 | ND | NA |
| 1A3 | 0.11 | 7.57E-5 | ND | NA |
| P166 | 0.14 | 9.72E-5 | ND | NA |
| P1H8 | 0.21 | 8.99E-5 | ND | NA |
| P8G4 | 0.21 | 2.76E-4 | ND | NA |

NA = does not apply;
ND = no binding detected

For exemplary antibodies 1C1 and 3P10, affinity is driven mainly by a very slow off-rate (see, e.g., FIG. 3). Antibodies that bind to GFRAL as shown in Table 26 above do not recognize (e.g., bind to) GNFR alpha 1, the most closely related homolog of GFRAL.

Example 3: Functional Assays

Antibodies to GFRAL generated, for example, such as described in Example 1, were tested for their functional activity in cell-based reporter assays.

For example, ELK1-luciferase reporter assays, which measure human GDF15 (hGDF15)-induced human GFRAL/RET signaling, were performed using transiently transfected HEK293T. The transfecting plasmids consisted of two reporter plasmids, Gal4-Elk1 and 5xUAS-Luc (Agilent Technologies PathDetect Elk1 trans-reporting system Cat#219005), and plasmids encoding human GFRAL (hGFRAL), cynomolgus monkey GFRAL (cynoGFRAL), mouse GFRAL (mGFRAL), or rat GFRAL (rGFRAL), and human RET (hRET), cynomolgus monkey RET (cynoRET), mouse RET (mRET) or rat RET (rRET). In these assays, hGDF15-induced activation of recombinantly expressed GFRAL/RET receptor complex in the cells triggers intracellular signaling transduction, which leads to ERK and then Elk1 phosphorylation. Once Gal4-Elk1 is phosphorylated, Gal4-Elk1 binds to the 5xUAS promoter region and turns on luciferase reporter gene transcription. The activity of luciferase is then measured in luciferase enzymatic assays.

Representative results for antibodies to GFRAL inhibiting human GFRAL/RET signaling are shown in Table 27 below.

TABLE 27

| | $IC_{50}$ (nM) | |
|---|---|---|
| Clone ID | hGFRAL/hRET | mGFRAL/mRET |
| 5F12 | 0.834 | 6.276 |
| 3P10 | 4.088 | 1.029 |
| 17J16 | 0.6658 | 0.4075 |
| 6G9 | 2.65 | ND |
| 2B8 | 1.923 | 2.449 |
| 6N16 | 1.618 | ND |
| 8C10 | 1.786 | WB |
| 2B11 | 7.896 | ND |
| 25M22 | 2.887 | 1.113 |
| 12A3 | 4.993 | 0.9334 |
| 1B3 | 4.136 | ND |
| 19K19 | 3.877 | 0.8948 |
| 1C1 | 8.638 | 1.189 |
| 8D8 | 2.106 | 1.419 |
| 22N5 | 7.744 | 2.599 |
| 2A9 | 3.706 | 7.871 |
| 2B3 | 7.124 | 7.761 |
| 24G2 | 18.94 | 8.324 |
| 5A20 | 3.19 | 0.6 |
| 2I23 | 7.185 | NP |
| 1A3 | ND | NP |
| P1B6 | ND | NP |
| P1H8 | ND | NP |
| P8G4 | ND | NP |

ND = blocking not detected in assay
NP = assay not performed
WB = weak blocking detected in assay For some experiments, the above mentioned four plasmids (e.g., 2 reporter plasmids, GFRAL, RET) were transfected into newly harvested cells in suspension using FuGene6 transfection reagent (Promega). The GFRAL and RET DNA ratio in transfection was optimized for the each pair of receptors from indicated species and varied between 12:1 to 60:1. Transfected cells were seeded into 384-well plate (7500 cells/25 μL/well) in normal growth medium. After overnight incubation at 37° C., a mix of serially diluted antibodies and fixed concentration of hGDF15 were added. After 6 hrs at 37° C. incubation with the antibodies, an equal volume of Bright-Glo reagent (Promega) was added and luminescence signal was read using Enspire reader (Perkin Elmer).

Simultaneous addition of antibodies, antagonizing the hGDF15 effect, blocked hGDF15 signaling in a dose-dependent manner preventing expression of luciferase reporter gene.

Example 4: Additional Functional Assays

Anti-hGFRAL antibodies were tested for their hGDF15 antagonising activity in an additional cell-based assay, such as an U2OS assay stably expressing hGFRAL and hRET. One day before the assay, the cells were plated in 90 μl of DiscoveRx Assay Complete Cell Plating 16 Reagent (DiscoveRx, Cat#93-0563R16B) at 20K/each of 96 well plate. Next day the cells were treated with a mix of serially diluted antibodies and a fixed concentration of hGDF15 for 10 minutes at 37° C. Cis-bio Cellul'erk assay kit (Cat#64ERKPEH) was used to assay for ERK phosphorylation level following the manufacturer's protocol. Similar to the Hek293T Elk1 reporter assay, hGDF15 antagonising antibodies were able to prevent hGDF15-induced phosphorylation in a dose-dependent manner.

Representative results for antibodies to GFRAL preventing hGDF15-induced phosphorylation are shown in Table 28 below.

TABLE 28

| Clone ID | IC$_{50}$ (nM) |
|---|---|
| 5F12 | 0.06 |
| 3P10 | 0.08 |
| 17J16 | 0.10 |
| 6G9 | 0.17 |
| 2B8 | 0.22 |
| 6N16 | 0.27 |
| 8C10 | 0.28 |
| 2B11 | 0.46 |
| 25M22 | 0.53 |
| 12A3 | 0.54 |
| 1B3 | 0.57 |
| 19K19 | 0.61 |
| 1C1 | 0.61 |
| 8D8 | 0.63 |
| 22N5 | 0.90 |
| 2A9 | 0.94 |
| 2B3 | 1.48 |
| 24G2 | 1.86 |
| 5A20 | 1.80 |
| 2I23 | NP |
| 1A3 | NP |
| P166 | NP |
| P1H8 | NP |
| P8G4 | NP |

NP = assay not performed

Example 5: Ligand Competition, Domain Mapping and Epitope Binning

Antibodies that were selected for binding to GFRAL were evaluated in ligand competition binding assays, domain and epitope binning experiments.

Briefly, ligand competition binding assays were performed by capturing GFRAL-Fc protein or RET and GFRAL Fc-heterodimers onto ELISA plates by anti-human Fc. Plates were blocked using PBS/1% BSA. 15 µL of a dose titration of antibodies were added to the wells starting at 10 µg/mL with a 3× dilution and incubated at room temperature for 30 min. Without washing, biotinyated GDF15 (GFRAL ligand) was added to the wells for an additional 1 hr. After 3 washes, 15 µL of HRP-streptavidin secondary were added to the wells and incubated at room temperature for 1 hr. After 3 washes, 15 µL of TMB were used to develop the plate. A positive signal indicates that biotinylated GDF15 still binds to GFRAL captured on the plate and the antibody is not a ligand competitor. A negative signal indicates that biotinylated GDF15 no longer binds to GFRAL captured on the plate and the antibody is a ligand competitor.

Briefly, domain mapping assays were performed by transiently transfecting 293EXPI cells with nucleic acid sequences encoding GFRAL (SEQ, GFRAL domain 1, GFRAL domain 2, GFRAL domain 1+2, GFRAL domain 1+3, GFRAL domain 2+3, or GFRAL domain 3.

Seven GFRAL deletion constructs (Constructs 1 to 7) were tested, which included the following features contiguously from N-terminus to C-terminus: IgK signal sequence (depicted by lower case and underlined letters in the below sequences), FLAG tag sequence (depicted by lower case and italicized letters in the below sequences) and GFRAL protein sequences with various extracellular domain combinations (domain 1 depicted in bold capital letters; domain 2 depicted in underlined capital letters; domain 3 depicted in bold and underlined letters). Construct 1 (IgK-2Flag-GFRAL; SEQ ID NO: 1817) contained human GDF15 polypeptide (residues Q20 to L394), in which domains 1, 2 and 3 were present. Construct 2 (IgK-2Flag-GFRAL domain 1; SEQ ID NO: 1818) contained GFRAL-ΔD2,ΔD3 (residues Q20 to S130 and F317 to L394), in which domains 2 and 3 were deleted. Construct 3 (IgK-2Flag-GFRAL domain 2; SEQ ID NO: 1819) contained GFRAL-ΔD1,ΔD3 (residues S121 to C210 and F317 to L394), in which domains 1 and 3 are deleted. Construct 4 (IgK-2Flag-GFRAL domain 1+2; SEQ ID NO: 1820) contained GFRAL-ΔD3 (residues Q20 to C210 and F317 to L394), in which domain 3 was deleted. Construct 5 (IgK-2Flag-GFRAL domain 1+3; SEQ ID NO: 1821) contained GFRAL-ΔD2 (residues Q20 to S130 and C220 to L394), in which domain 2 was deleted. Construct 6 (IgK-2Flag-GFRAL domain 2+3; SEQ ID NO: 1822) contained GFRAL-ΔD1 (residues S121 to L394), in which domain 1 was deleted. Construct 7 (IgK-2Flag-GFRAL domain 3; SEQ ID NO: 1823) contained GFRAL-ΔD14D2 (residues A211 to L394), in which domains 2 and 3 were deleted.

```
Construct 1 (IgK-2Flag-GFRAL; SEQ ID NO: 1817)
mdmrvpaqlldllllwlrgarcdykddddksaggdykddddkggQTNNCTYLREQCLRDA

NGCKHAWRVMEDACNDSDPGDPCKMRNSSYCNLSIQYLVESNFQFKE

CLCTDDFYCTVNKLLGKKCINKSDNVKEDKFKWNLTTRSHHGFKGMW

SCLEVAEACVGDVVCNAQLASYLKACSANGNPCDLKQCQAAIRFFYQNI

PFNIAQMLAFCDCAQSDIPCQQSKEALHSKTCAVNMVPPPTCLSVIRSC

QNDELCRRHYRTFQSKCWQRVTRKCHEDENCISTLSKQDLTCSGSDD

CKAAYIDILGTVLQVQCTCRTITQSEESLCKIFQHMLHRKSCFNYPTLSN

VKGMALYTRKHANKITLTGFHSPFNGEVIYAAMCMTVTCGILLLVMVKLR

TSRISSKARDPSSIQIPGEL

Construct 2 (IgK-2Flag-GFRAL domain 1; SEQ ID NO: 1818)
mdmrvpaqllqllllwlroarcdykddddksaggdykddddkggQTNNCTYLREQCLRDA

NGCKHAWRVMEDACNDSDPGDPCKMRNSSYCNLSIQYLVESNFQFKE

CLCTDDFYCTVNKLLGKKCINKSDNVKEDKFKWNLTTRSHHGFKGMW

SFNYPTLSNVKGMALYTRKHANKITLTGFHSPFNGEVIYAAMCMTVTCGI

LLLVMVKLRTSRISSKARDPSSIQIPGEL
```

-continued

Construct 3 (IgK-2Flag-GFRAL domain 2; SEQ ID NO: 1819)
mdmrvpaqllglllllwlrdarcdykddddksaggdykddddkggSHHGFKGMWSCLEVA

EACVGDVVCNAQLASYLKACSANGNPCDLKQCQAAIRFFYQNIPFNIAQ

MLAFCDCAQSDIPCQQSKEALHSKTCFNYPTLSNVKGMALYTRKHANKI

TLTGFHSPFNGEVIYAAMCMTVTCGILLLVMVKLRTSRISSKARDPSSIQI

PGEL

Construct 4 (IgK-2Flag-GFRAL domain 1 + 2; SEQ ID NO: 1820)
mdmrvpaqllglllllwlrgarcdykddddksaggdykddddkggQTNNCTYLREQCLRDA

NGCKHAWRVMEDACNDSDPGDPCKMRNSSYCNLSIQYLVESNFQFKE

CLCTDDFYCTVNKLLGKKCINKSDNVKEDKFKWNLTTRSHHGFKGMW

SCLEVAEACVGDVVCNAQLASYLKACSANGNPCDLKQCQAAIRFFYQNI

PFNIAQMLAFCDCAQSDIPCQQSKEALHSKTCFNYPTLSNVKGMALYTR

KHANKITLTGFHSPFNGEVIYAAMCMTVTCGILLLVMVKLRTSRISSKARD

PSSIQIPGEL

Construct 5 (IgK-2Flag-GFRAL domain 1 + 3; SEQ ID NO: 1821)
mdmrvpaqllglllllwlrgarcdykddddksaggdykddddkggQTNNCTYLREQCLRDA

NGCKHAWRVMEDACNDSDPGDPCKMRNSSYCNLSIQYLVESNFQFKE

CLCTDDFYCTVNKLLGKKCINKSDNVKEDKFKWNLTTRSHHGFKGMW

SCLSVIRSCQNDELCRRHYRTFQSKCWQRVTRKCHEDENCISTLSKQD

LTCSGSDDCKAAYIDILGTVLQVQCTCRTITQSEESLCKIFQHMLHRKSC

FNYPTLSNVKGMALYTRKHANKITLTGFHSPFNGEVIYAAMCMTVTCGIL

LLVMVKLRTSRISSKARDPSSIQIPGEL

Construct 6 (IgK-2Flag-GFRAL domain 2 + 3; SEQ ID NO: 1822)
mdmrvpaqllglllllwlrgarcdykddddksaggdykddddkggSHHGFKGMWSCLEVA

EACVGDVVCNAQLASYLKACSANGNPCDLKQCQAAIRFFYQNIPFNIAQ

MLAFCDCAQSDIPCQQSKEALHSKTCAVNMVPPPTCLSVIRSCQNDELC

RRHYRTFQSKCWQRVTRKCHEDENCISTLSKQDLTCSGSDDCKAAYID

ILGTVLQVQCTCRTITQSEESLCKIFQHMLHRKSCFNYPTLSNVKGMAL

YTRKHANKITLTGFHSPFNGEVIYAAMCMTVTCGILLLVMVKLRTSRISSK

ARDPSSIQIPGEL

Construct 7 (IgK-2Flag-GFRAL domain 3; SEQ ID NO: 1823)
mdmrvpaqllglllllwlrgarcdykddddksaggdykddddkggAVNMVPPPTCLSVIRSC

QNDELCRRHYRTFQSKCWQRVTRKCHEDENCISTLSKQDLTCSGSDD

CKAAYIDILGTVLQVQCTCRTITQSEESLCKIFQHMLHRKSCFNYPTLSN

VKGMALYTRKHANKITLTGFHSPFNGEVIYAAMCMTVTCGILLLVMVKLR

TSRISSKARDPSSIQIPGEL

Cells were incubated with 1 μg/mL of antibodies for 30 mins at 4° C. After washing, cells were incubated with a fluorochrome labeled anti-mouse Fc secondary antibody either A488 or A647 for 30 mins at 4° C. After washing, cells were analyzed by FACs. A positive signal indicates that the antibody binds to the domain overexpressed by the transfected 293EXPI cells. A negative signal indicates that the antibody does not bind to the domain overexpressed by the transfected 293EXPI cells.

Briefly, epitope binning assays were performed by directly coating plates with 2 ug/mL of antibodies (mAb1). Plates were blocked using PBS/1% BSA. 2 μg/mL of antibodies (mAb2) were pre-incubated with 50 ng/mL of GFRAL-Fc protein for 30 min before adding to wells at room temperature for 1 hr. After 3 washes, 15 μL of HRP-anti-human Fc secondary were added to the wells and incubated at room temperature for 1 hr. After 3 washes, 15 μL of TMB were used to develop the plate. A positive signal indicates that GFRAL-Fc protein still binds to the captured antibody (mAb1) on the plate and antibody (mAb2) is not in the same epitope bin as the captured antibody (mAb1). A negative signal indicates that GFRAL-Fc protein no longer binds to the captured antibody (mAb1) on the plate and antibody (mAb2) is in the same epitope bin as the captured antibody (mAb1).

Representative results for inhibition of GDF15 binding to GFRAL, domain mapping of GFRAL and epitope binning are shown in Table 29 below.

TABLE 29

| Clone ID | Inhibition | GFRAL Domain | Epitope Bin |
|---|---|---|---|
| 5F12 | No | D3 | 4 |
| 3P10 | No | D3 | 4 |
| 17J16 | Partial | D2 | 1 |
| 6G9 | No | D3 | 4 |
| 2B8 | Yes | — | 2 |
| 6N16 | No | D3 | 4 |
| 8C10 | Yes | D2 | 2 |
| 2B11 | No | D3 | 4 |
| 25M22 | Yes | D2 | 2 |
| 12A3 | Yes | D2 | 2 |
| 1B3 | No | D3 | 4 |
| 19K19 | Yes | D2 | 2 |
| 1C1 | Yes | D2 | 3 |
| 8D8 | Yes | D2 | 1 |
| 22N5 | Yes | D2 | 3 |
| 2A9 | Yes | D2 | 3 |
| 2B3 | Yes | ND | 1 |
| 24G2 | Yes | NA | 1 |
| 5A20 | Partial | D2 | 1 |
| 2I23 | No | NA | 4 |
| 1A3 | No | D1 | 5 |
| P1B6 | No | D1 | 5 |
| P1H8 | No | D1 | 7 |
| P8G4 | No | D1 | 6 |

NA = does not apply;
ND = no binding detected

As shown in Table 29 above, at least three classes of anti-GFRAL antibodies were identified, including antibodies that block GDF15 binding (e.g., competitive antagonists), antibodies that do not block GDF15 binding (e.g., non-competitive antagonists), and partial blockers of GDF15 binding. Antibodies were also identified as binding to domain 1, domain 2 or domain 3 of GFRAL. The antibodies that bound to domain 2 were found to either inhibit GDF15 binding to GFRAL or at leastly partially inhibit this binding. The antibodies that bound to domains 1 or 3 did not inhibit GDF15 binding to GFRAL.

An alignment of exemplary anti-GFRAL antibodies assayed in Examples 2-4 and described above is shown in FIGS. 4A-4B.

Alignments of VH and VL domains for antibodies that were found to bind domain 1, domain 2 or domain 3 are shown in FIGS. 5A-5F, respectively.

Example 6: Humanization

Humanized anti-GFRAL antibodies were generated, including from antibodies selected as described in Examples 1-5. Exemplary humanized antibodies are generated comprising one or more CDRs from Tables 1-24, including, for example, the CDRs for the antibody designated 1C1 (see, e.g., Table 1), for the antibody designated 25M22 (see, e.g., Table 8), for the antibody designated 17J16 (see, e.g., Table 7), for the antibody designated 5F12 (see, e.g., Table 4), and for the antibody designated 3P10 (see, e.g., Table 2). The sequences of VH and VL regions for exemplary humanized antibodies 1C1, 25M22, 17J16, 5F12, and 3P10 are shown in FIGS. 6A-6B, 7A-7B, 8A-8B, 9A-9B, and 10A-10B.

A number of anti-GFRAL antibodies were selected for sequencing and subsequently for humanization. An NCBI immunoglobulin (Ig) sequence blastp search was conducted to identify human germ line sequences with significant similarity to mouse VH and VL sequences. Examples for potential human framework sequences are given in Table 30. Considering sequence similarities, biophysical properties and potential immunogenicity, germ line sequences for IGH and IGK were chosen as human framework sequences. The germ line sequences that were chosen are highlighted in bold in Table 30. In order to identify the best matching framework 4 sequence, a similar approach was taken for choosing JH and JK germline sequences, and these chosen sequences are also highlighted in bold in Table 30.

TABLE 30

| Clone ID | Human germline donor sequence for VH | Human germline donor sequence for JH | Human germline donor sequence for VL | Human germline donor sequence for JK |
|---|---|---|---|---|
| 3P10 | IGHV1-18 | IGHJ6 | IGKV1-39 | IGKJ4 |
|  | IGHV1-3 | IGHJ1 | IGKV3-20 | IGKJ2 |
|  | IGHV1-46 |  | IGKV2-30 |  |
|  | IGHV1-2 |  | IGK4-1 |  |
|  | IGHV1-69 |  | IGK3-11 |  |
| 5F12 | IGHV1-46 | IGHJ1 | IGKV4-1 | IGKJ4 |
|  | IGHV1-3 | IGHJ3 | IGKV2-30 | IGKJ2 |
|  | IGHV1-69 |  | IGKV1-39 |  |
|  | IGHV1-2 |  | IGKV3-11 |  |
|  |  |  | IGKV1-5 |  |
|  |  |  | IGKV1-27 |  |
| 25M22 | IGHV5-51 | IGHJ6 | IGKV2-29 | IGKJ4 |
|  | IGHV1-46 | IGHJ4 | IGKV2-28 | IGKJ2 |
|  | IGHV1-3 |  | IGKV2-18 |  |
|  | IGHV1-2 |  | IGKV2-30 |  |
|  | IGHV1-69 |  | IGKV3-20 |  |
|  | IGHV1-18 |  | IGKV1-39 |  |
| 1C1 | IGHV4-39 | IGHJ4 | IGKV3-20 | IGKJ4 |
|  | IGHV4-31 | IGHJ6 | IGKV1-39 | IGKJ2 |
|  | IGHV3-33 |  | IGKV2-30 |  |
|  | IGHV4-59 |  | IGKV2-28 |  |
| 17J16 | IGHV1-2 | IGHJ6 | IGKV2-30 | IGKJ4 |
|  | IGHV1-46 |  | IGKV2-29 | IGKJ2 |
|  | IGHV1-3 |  | IGKV2-40 |  |
|  | IGHV1-69 |  | IGKV3-20 |  |
|  |  |  | IGKV1-39 |  |
| 1A3 | IGHV5-51 | IGHJ6 | IGKV2-28 | IGKJ4 |
|  | IGHV1-69 | IGHJ4 | IGKV2-30 | IGKJ2 |
|  | IGHV1-46 |  | IGKV4-1 |  |
|  | IGHV1-2 |  |  |  |
| P1B6 | IGHV5-51 | IGHJ4 | IGKV3-11 | IGKJ4 |
|  | IGHV1-69 | IGHJ1 | IGKV1-9 | IGKJ2 |
|  | IGHV1-46 |  | IGKV1-5 |  |
|  | IGHV1-2 |  | IGKV3-15 |  |
|  |  |  | IGKV1-33 |  |
|  |  |  | IGKV3-20 |  |
| P1H8 | IGHV5-51 | IGHJ6 | IGHV2-28 | IGKJ4 |
|  | IGHV1-69 | IGHJ4 | IGHV2-30 | IGKJ2 |
|  | IGHV1-46 |  | IGHV4-1 |  |
|  | IGHV1-2 |  |  |  |
| P8G4 | IGHV4-59 | IGHJ4 | IGKV3-11 | IGKJ1 |
|  | IGHV3-23 | IGHJ6 | IGKV1-39 | IGKJ2 |
|  | IGHV4-4 |  | IGKV1-5 |  |
|  | IGHV3-30 |  | IGKV3-20 |  |

The CDR sequences of murine antibodies were then transferred (e.g., grafted) to the corresponding positions of human IGH and IGK and J-region residues corresponding to framework four were added. The resulting protein sequence was back translated into a DNA sequence, codon optimized for expression in mammalian cells and synthesized (GeneArt/LifeTechnologies). Subsequently, the synthesized DNA fragment was cloned using In-Fusion technology (Clontech) into pTT5 vector (NRC Biotechnology Research Institute) to create expression ready constructs that contain a Kozak sequence, the hIgK signal peptide followed by the humanized variable-region of the desired antibody plus the constant region of the antibody (hIgG1/hIgK). At the same time individual residues in the framework regions were selected to be back-mutated to mouse residues in order to retain binding affinities. Special consideration was given to Vernier Zone residues. Such variants were either created by side directed mutatgenesis (QuickChange, Agilent) or de-novo DNA synthesis. Such expression constructs were then used for transient protein expression in Expi293 cells (Thermo Fischer), secreted antibodies were purified from tissue culture supernatant and tested for binding affinities. In order to optimize for binding affinity and lowest number of necessary back mutations, a second round of construct designs were typically made followed by antibody expression, purification and measurement of binding affinities.

Exemplary humanized anti-GFRAL antibodies include an antibody comprising: a VH that is SEQ ID NO: 1982 (HC-344e) and VL that is SEQ ID NO: 1997 (LC-344h), a VH that is SEQ ID NO: 1978 (HC-344a) and VL that is SEQ ID NO: 1992 (LC-344c); a VH that is SEQ ID NO: 1978 (HC-344a) and VL that is SEQ ID NO: 1997 (LC-344h); a VH that is SEQ ID NO: 1985 (HC-344h) and VL that is SEQ ID NO: 1997 (LC-344h); a VH that is SEQ ID NO: 1961 (HC-375d) and VL that is SEQ ID NO: 1976 (LC-375j); a VH that is SEQ ID NO: 1962 (HC-375e) and VL that is SEQ ID NO: 1976 (LC-375j); a VH that is SEQ ID NO: 1964 (HC-375g) and VL that is SEQ ID NO: 1967 (LC-375a); or a VH that is SEQ ID NO: 1964 (HC-375g) and VL that is SEQ ID NO: 1976 (LC-375j). [

Example 7: Selection of Humanized Antibodies

Exemplary humanized anti-GFRAL antibodies identified in Example 6 were assayed for their binding affinity to human GFRAL. Binding affinity measurements were made in Biacore based assays. For example, equilibrium dissociation constant ($K_D$) measurements were carried out with purified antibodies to evaluate their binding to human GFRAL. Using methods described in Example II, anti-mouse Fc antibody (Sigma-Aldrich, St. Louis, Mo.) was immobilized on all four flow cells of a CM5 chip using amine coupling reagents (GE Healthcare LifeSciences, Piscataway, N.J.). Purified humanized anti-GFRAL antibodies were captured (~100 RUs) on flow cells 2, 3 and 4 using flow cell 1 as a reference. This was followed by injection of human GFRAL in PBS-P buffer) at a flow rate of 70 µL/min and the binding kinetics were evaluated at 25° C.

Representative results for binding affinity (e.g., $K_D$ (nM)) of exemplary humanized anti-GFRAL antibodies (e.g., humanized 3P10 and humanized 5F12) to human GFRAL are shown in Tables 31 and 32 below.

TABLE 31

| Humanized anti-GFRAL Antibodies | Binding Affinity to Human GFRAL $K_D$ (pM) |
|---|---|
| 3P10 Hybridoma | <10 |
| HC-344a/LC-344c | 12 |
| HC-344a/LC-344h | <10 |
| HC-344h/LC-344c | <10 |
| HC-344e/LC-344h | <10 |
| HC-344h/LC-344h | <10 |

TABLE 32

| Humanized anti-GFRAL Antibodies | Binding Affinity to Human GFRAL $K_D$ (pM) |
|---|---|
| 5F12 Hybridoma | 38 |
| HC-375d/LC-375a | 74 |
| HC-375d/LC-375c | 75 |
| HC-375d/LC-375g | 77 |
| HC-375d/LC-375i | 62 |
| HC-375d/LC-375j | 46 |
| HC-375e/LC-375a | 91 |
| HC-375e/LC-375c | 92 |
| HC-375e/LC-375g | 81 |
| HC-375e/LC-375j | 48 |
| HC-375h/LC-375g | 87 |
| HC-375h/LC-375j | 60 |
| HC-375g/LC-375a | 28 |
| HC-375g/LC-375j | 57 |

Example 8: Functional Assays of Humanized Antibodies

Exemplary humanized anti-GFRAL antibodies described in Examples 6 and 7 were tested for their functional activity in cell-based reporter assays similar to that described in Example 3.

For example, ELK1-luciferase reporter assays, which measure human GDF15 (hGDF15)-induced human GFRAL/RET signaling, were performed using transfected U2OS and HEK293T. The transfecting plasmids consisted of two reporter plasmids, Gal4-Elk1 and 5xUAS-Luc (Agilent Technologies PathDetect Elk1 trans-reporting system Cat#219005), and plasmids encoding human GFRAL (hGFRAL and human RET (hRET). In these assays, hGDF15-induced activation of recombinantly expressed GFRAL/RET receptor complex in the cells triggers intracellular signaling transduction, which leads to ERK and then Elk1 phosphorylation. Once Gal4-Elk1 is phosphorylated, Gal4-Elk1 binds to the 5xUAS promoter region and turns on luciferase reporter gene transcription. The activity of luciferase is then measured in luciferase enzymatic assays.

Figure 11:
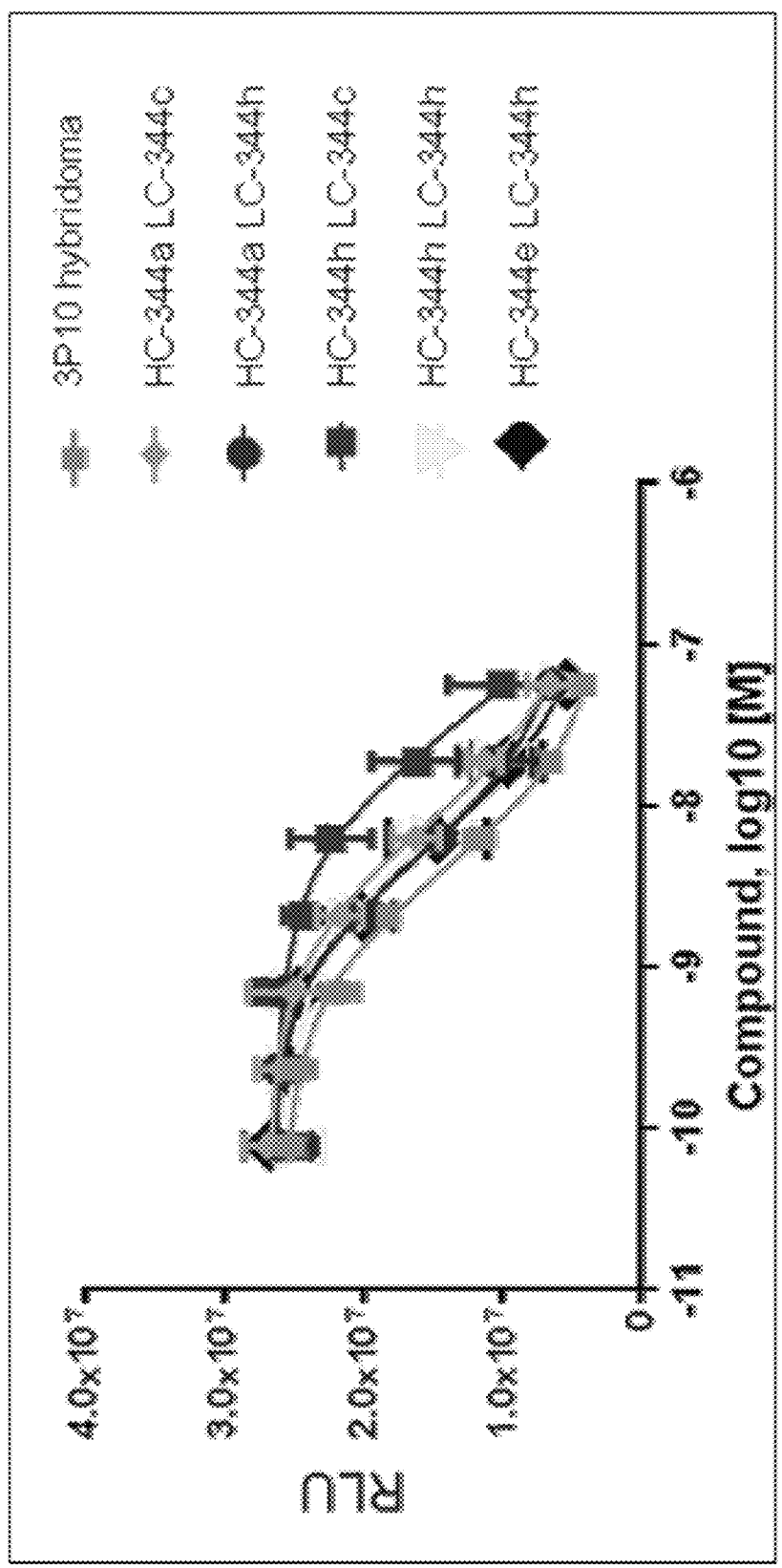
FIG. 11 depicts results of a receptor antagonist assay using a humanized GFRAL antibody.

Representative results for exemplary humanized antibodies to GFRAL (e.g., 3P10 and 5F12) inhibiting human GFRAL/RET signaling are shown in Table 33 and 34 below and in FIG. 11.

TABLE 33

| Humanized anti-GFRAL Antibodies | $IC_{50}$ (nM) |
|---|---|
| 3P10 Hybridoma | 4.02 |
| HC-344a/LC-344c | 7.26 |
| HC-344a/LC-344h | 4.63 |
| HC-344h/LC-344c | 29.4 |
| HC-344e/LC-344h | 6.95 |
| HC-344h/LC-344h | 5.7 |

TABLE 34

| Humanized anti-GFRAL Antibodies | $IC_{50}$ (nM) |
|---|---|
| 5F12 Hybridoma | 5.40 |
| HC-375d/LC-375a | 3.86 |
| HC-375d/LC-375c | 3.28 |
| HC-375d/LC-375g | 2.79 |
| HC-375d/LC-375i | 2.75 |
| HC-375d/LC-375j | 3.11 |

TABLE 34-continued

| Humanized anti-GFRAL Antibodies | IC$_{50}$ (nM) |
|---|---|
| HC-375e/LC-375a | 2.81 |
| HC-375e/LC-375c | 2.20 |
| HC-375e/LC-375g | 2.27 |
| HC-375e/LC-375j | 4.01 |
| HC-375h/LC-375g | 3.98 |
| HC-375h/LC-375j | 7.29 |

For some experiments, the above mentioned four plasmids (e.g., 2 reporter plasmids, GFRAL, RET) were transfected into newly harvested cells in suspension using FuGene6 transfection reagent (Promega). The GFRAL and RET DNA ratio in transfection was optimized for the each pair of receptors from indicated species and varied between 12:1 to 60:1. Transfected cells were seeded into 384-well plate (7500 cells/25 μL/well) in normal growth medium. After overnight incubation at 37° C., a mix of serially diluted antibodies and fixed concentration of hGDF15 were added. After 6 hrs at 37° C. incubation with the antibodies, an equal volume of Bright-Glo reagent (Promega) was added and luminescence signal was read using Enspire reader (Perkin Elmer).

Simultaneous addition of humanized anti-GFRAL antibodies, antagonizing the hGDF15 effect, blocked hGDF15 signaling in a dose-dependent manner preventing expression of luciferase reporter gene.

Example 9: Additional Functional Assays of Humanized Antibodies

Exemplary humanized anti-hGFRAL antibodies were tested for their hGDF15 antagonising activity in an additional cell-based assay, such as an U2OS assay stably expressing hGFRAL and hRET, as described in Example 4. One day before the assay, the cells were plated in 90 μl of DiscoveRx Assay Complete Cell Plating 16 Reagent (DiscoveRx, Cat#93-0563R16B) at 20K/each of 96 well plate. Next day the cells were treated with a mix of serially diluted antibodies and a fixed concentration of hGDF15 for 10 minutes at 37° C. Cis-bio Cellul'erk assay kit (Cat#64ERKPEH) was used to assay for ERK phosphorylation level following the manufacturer's protocol.

Similar to the Hek293T Elk1 reporter assay described in Example 4, humanized anti-hGFRAL antibodies (e.g., humanized 3P10) were able to prevent hGDF15-induced phosphorylation in a dose-dependent manner.

Figure 12:
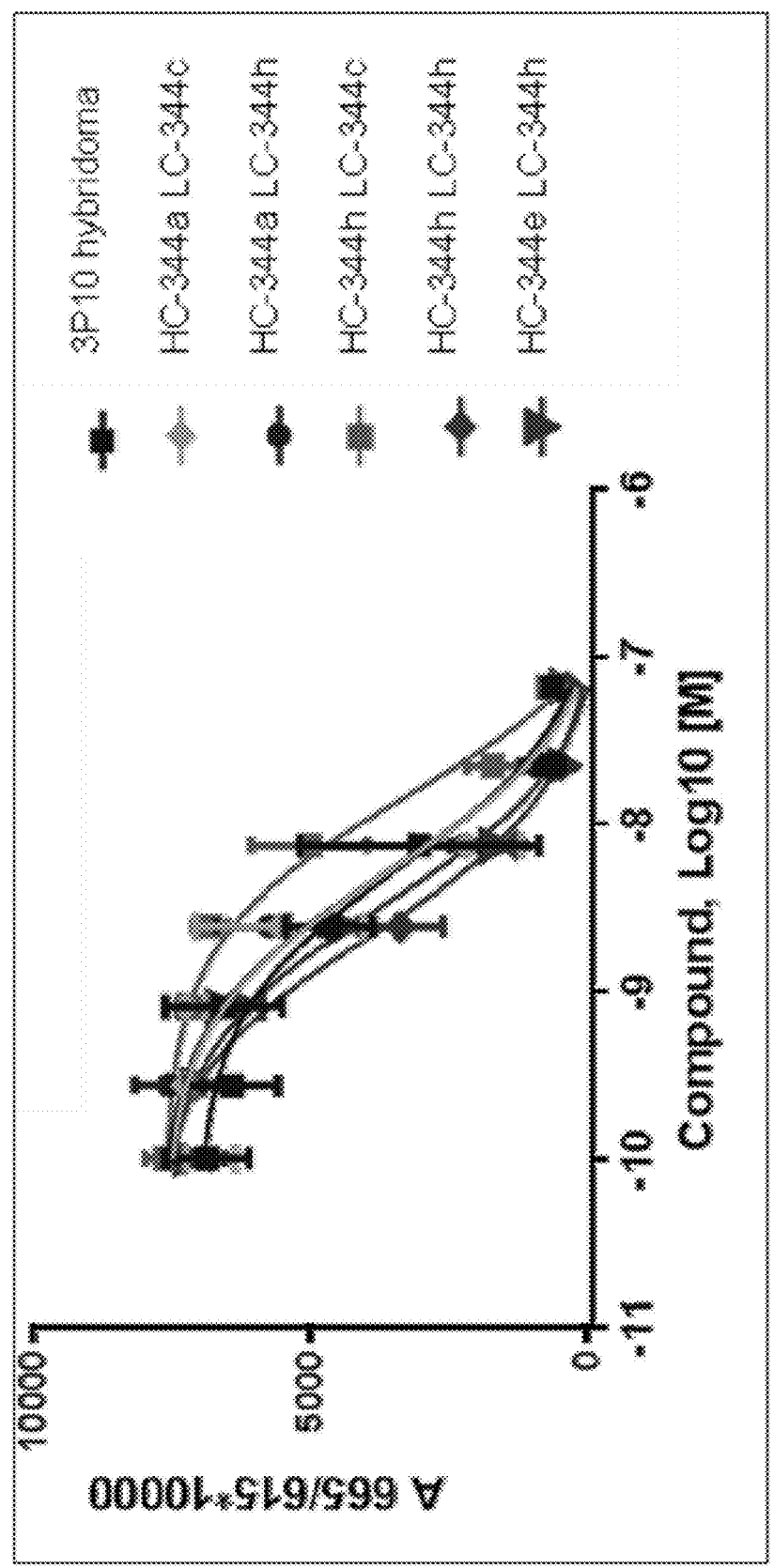
FIG. 12 depicts results for an Elk1 reporter assay showing of humanized antibodies.

Representative results for humanized anti-GFRAL antibodies preventing hGDF15-induced phosphorylation are shown in Table 35 below and in FIG. 12.

TABLE 35

| Humanized anti-GFRAL Antibodies | IC$_{50}$ (nM) |
|---|---|
| 3P10 Hybridoma | 5.46 |
| HC-344a/LC-344c | 5.13 |
| HC-344a/LC-344h | 5.02 |
| HC-344h/LC-344c | 15.1 |
| HC-344e/LC-344h | 3.3 |
| HC-344h/LC-344h | 2.18 |

Figure 13A:
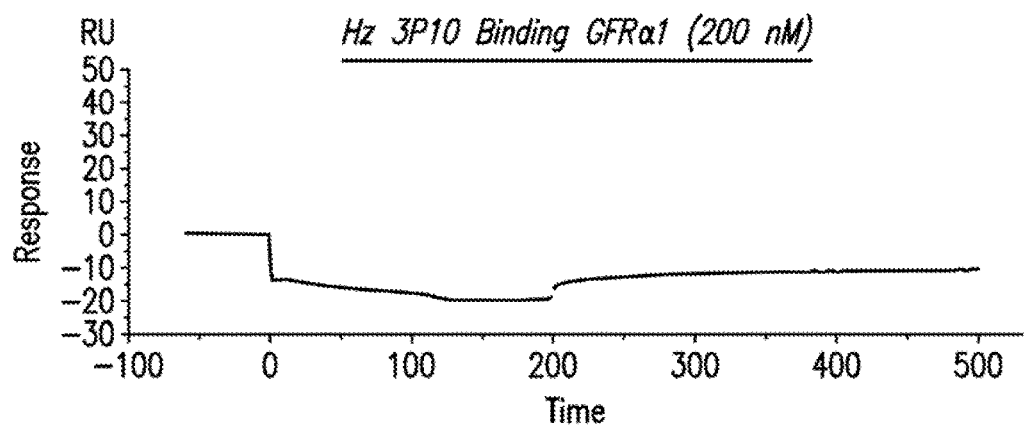
FIGS. 13A-13C depict results of an experiment showing specificity of an exemplary humanized anti-GFRAL antibody.
Figure 13B:
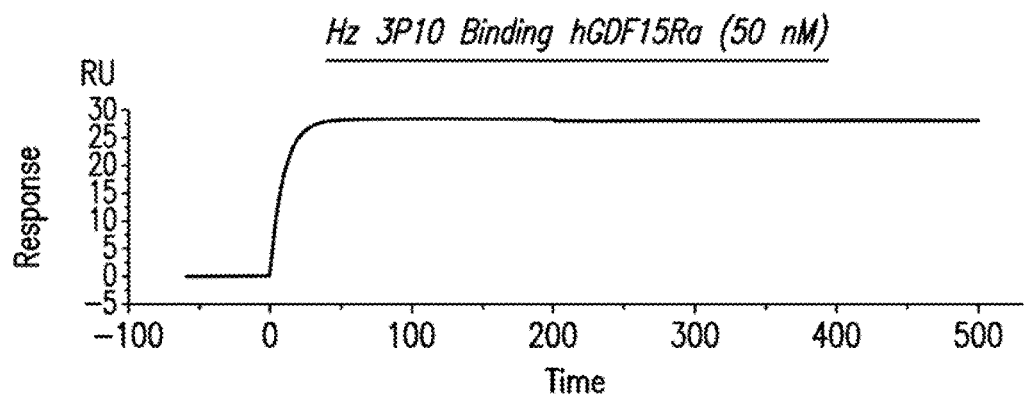
Figure 13C:
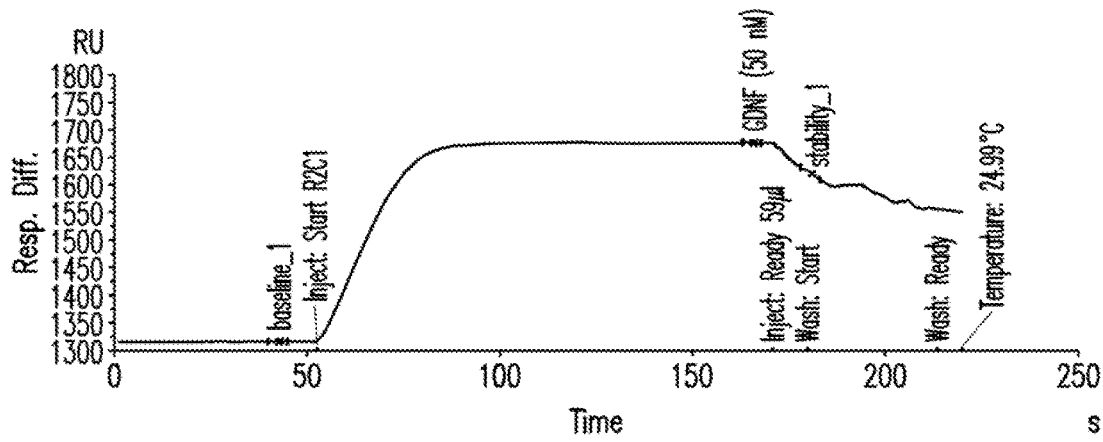

In a control experiment, GFRα1 (bound on chip surface) showed binding to its natural ligand GDNF (in solution, 50 nM) (see FIG. 13C).

Exemplary humanized anti-GFRAL antibodies (e.g. HC-344e+LC-344h) did not bind to receptor GFRα1, but showed high affinity binding to hGFRAL (FIGS. 13A and 13B) indicating specificity for GFRAL.

Example 10: Animal Studies

The effects of anti-GFRAL antibodies were evaluated in multiple animal studies.

A: Anti-GFRAL Antibodies Inhibit GDF15-Induced Weight Loss in DIO Mice (Acute)

To determine if an anti-GFRAL antibody is able to neutralize the GDF15-induced weight lowering effect in diet-induced obesity (DIO) mice, 17 week old male C57BL/6J DIO mice were used (Jackson Labs West, Sacramento, Calif.). Mice (41.3 g±0.4 g) were randomly assigned to receive an exemplary anti-GFRAL antibody (e.g., 1C1, 3P10, 17J16, 5A20, 25M22, 5F12, 8D8 and 12A3) or an anti-GDF15 antibody (e.g., 1MO3). Each group had 6 mice per group. Each treatment group had its own PBS control group. The antibody dosage was 20 mg/kg. One day post injections with either PBS or antibody, the mice then received 3 consecutive daily injections of a GDF15 protein (e.g., having an amino acid sequence of SEQ ID NO:1811) at 0.5 mg/kg. Daily body weight and food intake were recorded (day 1-3 and day 7). Sartorius balance LE5201 was used for weighing. An automatic weighing record program (Sartorius YSW05 Software Wedge, Sartorius Mechatronics Corporation, 5 Orville Drive, Suite 200 Bohemia, N.Y. 11716) was used to transmit the weight data to a Microsoft Excel spreadsheet automatically.

Data are presented by mean±sem in term of raw body weight, delta body weight change and percentage of body weight change (i.e., % of delta body weight change over baseline body weight). A Student's t-test was used (two tails, two ends). In these experiments, $P<0.05$ was considered as statistically significant.

Figure 14A:
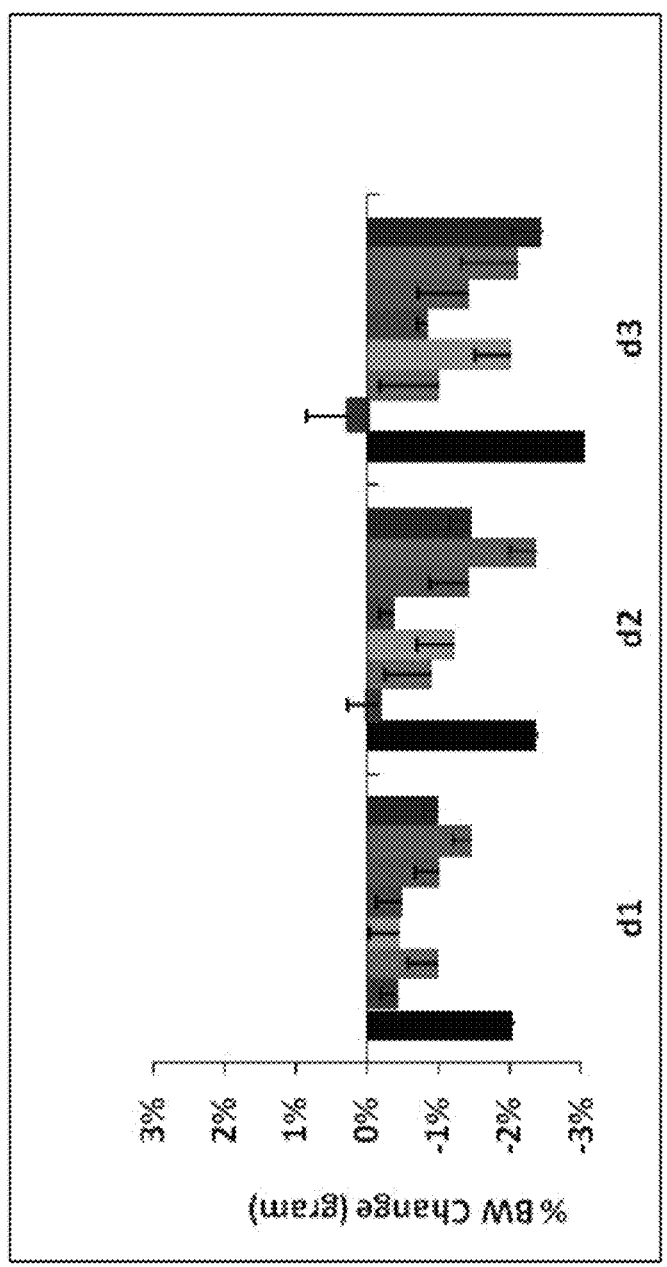
FIGS. 14A-14B depict results of an experiment showing anti-GFRAL antibody inhibition of GDF15-induced weight loss in DIO mice. For FIG. 14A, from left to right in the figure, the administered treatment was PBS, 3P10, 1C1, 17J16, 5A20, 25M22, 5F12, and 1MO3, respectively (for d1, d2 and d3, respectively). For FIG. 14B, from left to right in the figure, the administered treatment was PBS, 8D8 and 12A3, respectively (for d1, d2 and d3, respectively).
Figure 14B:
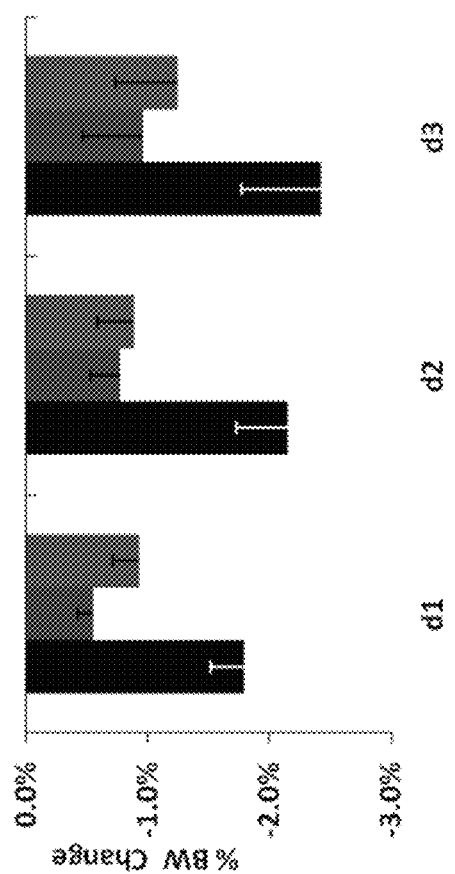

Exemplary anti-GFRAL antibodies, 1C1, 3P10, 17J16, 5A20, 25M22, 5F12, 8D8 and 12A3, are able to reverse GDF15-induced body weight loss and food intake reduction (FIGS. 14A and 14B). An anti-GDF15 antibody also reversed GDF15-induced body weight loss and food intake reduction in this model.

To determine if a non-competitive anti-GFRAL antibody or a competitive anti-GFRAL antibody block exogenous GDF15-induced weight lowering effect in a dose-dependent manner, 19 week old male C57BL/6J DIO mice were used. Initially mice (43.1 g±0.3 g) were randomly assigned to PBS (8 mice per group) or a GDF15 protein (e.g., having an amino acid sequence of SEQ ID NO: 1811) groups (0.1 mg/kg, 1.0 mg/kg, or 10 mg/kg, 24 mice per group). A GDF15 protein was confirmed to reduce body weight and food intake dose-dependently in the following day. Furthermore, the GDF15 treatment groups (0.1 mg/kg, 1.0 mg/kg, or 10 mg/kg) were randomly assigned to receive PBS, or an exemplary anti-GFRAL antibody (e.g., 1C1 or 3P10) (8 mice per group). Daily body weight and food intake were recorded (day 1-3 and day 7).

Figure 15:
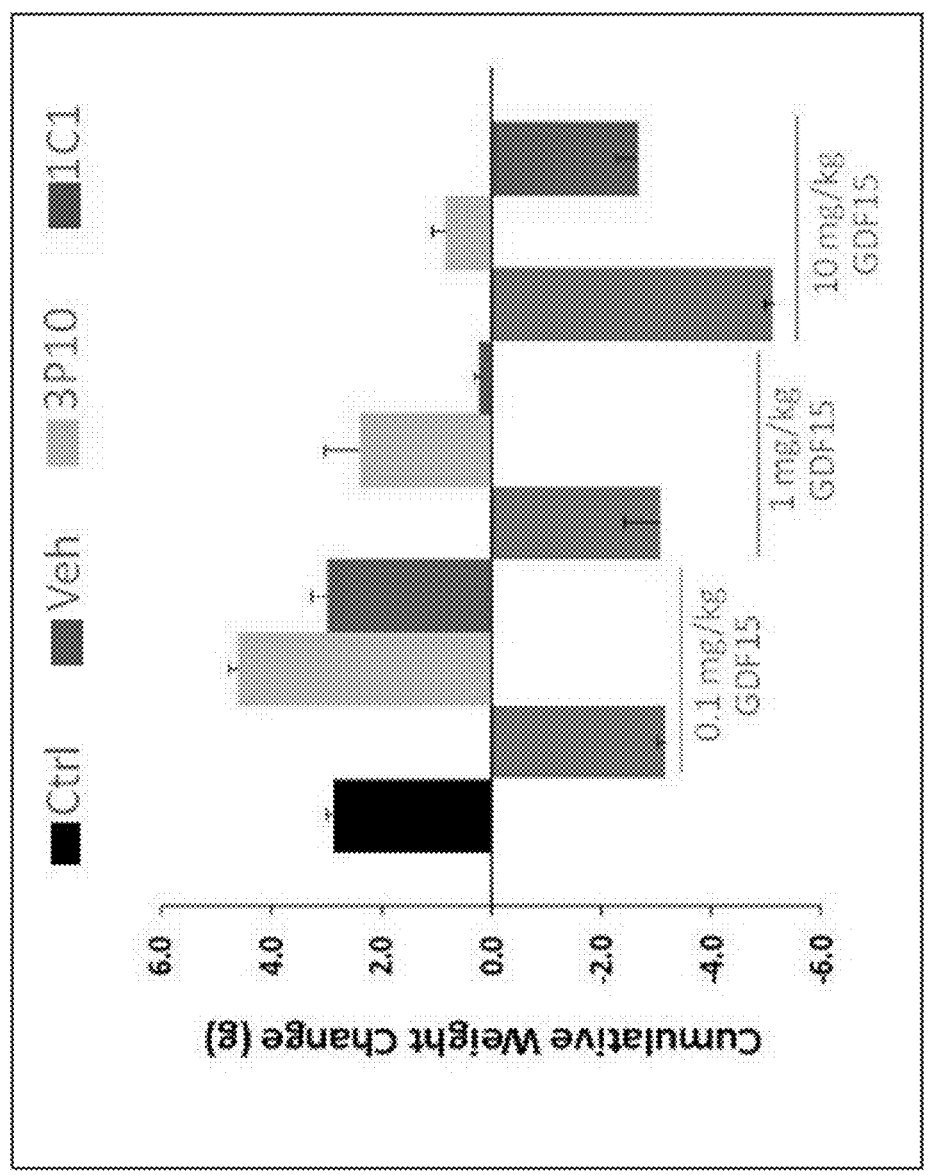
FIG. 15 depicts results of an experiment showing anti-GFRAL antibodies in a model of GDF15-induced weight loss.
Figure 16:
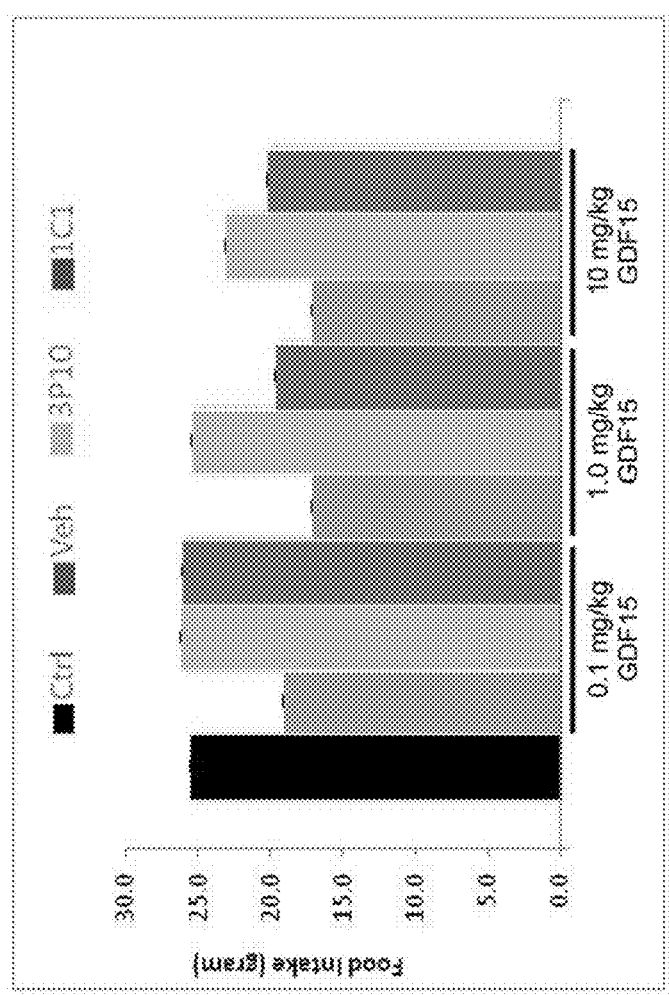
FIG. 16 depicts results of an experiment showing the effects of anti-GFRAL antibodies on food intake.

Exemplary anti-GFRAL antibodies reversed body weight reduction and food intake reduction that was induced by GDF15 (FIGS. 15 and 16).

B: Anti-GFRAL Antibodies Promote Body Weight Gain in DIO Mice (Chronic)

To determine if an exemplary anti-GFRAL antibody is able to increase body weight independent of exogenous GDF15 protein in a DIO model, 14 week old male C57BL/6J DIO mice were used (Jackson Labs West, Sacramento, Calif.). Mice (34.5 g±0.8 g) were randomly assigned to receive either PBS or exemplary anti-GFRAL antibodies (e.g., 1C1 or 3P10) at 10 mg/kg weekly. Each group had 10 mice per group. Daily body weight and food intake were recorded for 28 days. Sartorius balance LE5201 was used for weighing. An automatic weighing record program (Sartorius YSW05 Software Wedge, Sartorius Mechatronics Corporation, 5 Orville Drive, Suite 200 Bohemia, N.Y. 11716) was used to transmit the weight data to a Microsoft Excel spreadsheet automatically. Body composition was also evaluated by EchoMRI.

Figure 17:
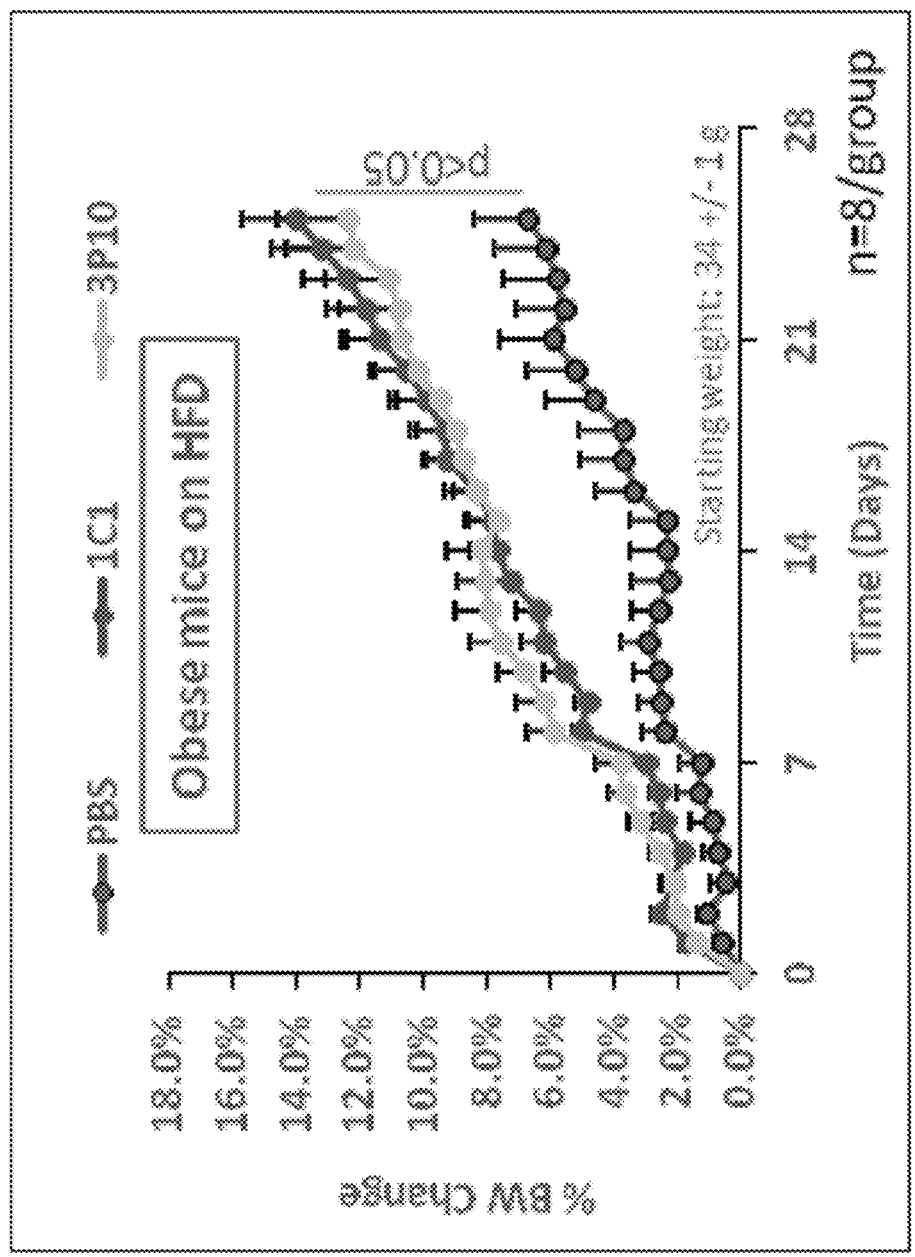
FIG. 17 depicts results of an experiment showing the effects of anti-GFRAL antibodies on body weight in DIO mice.
Figure 18:
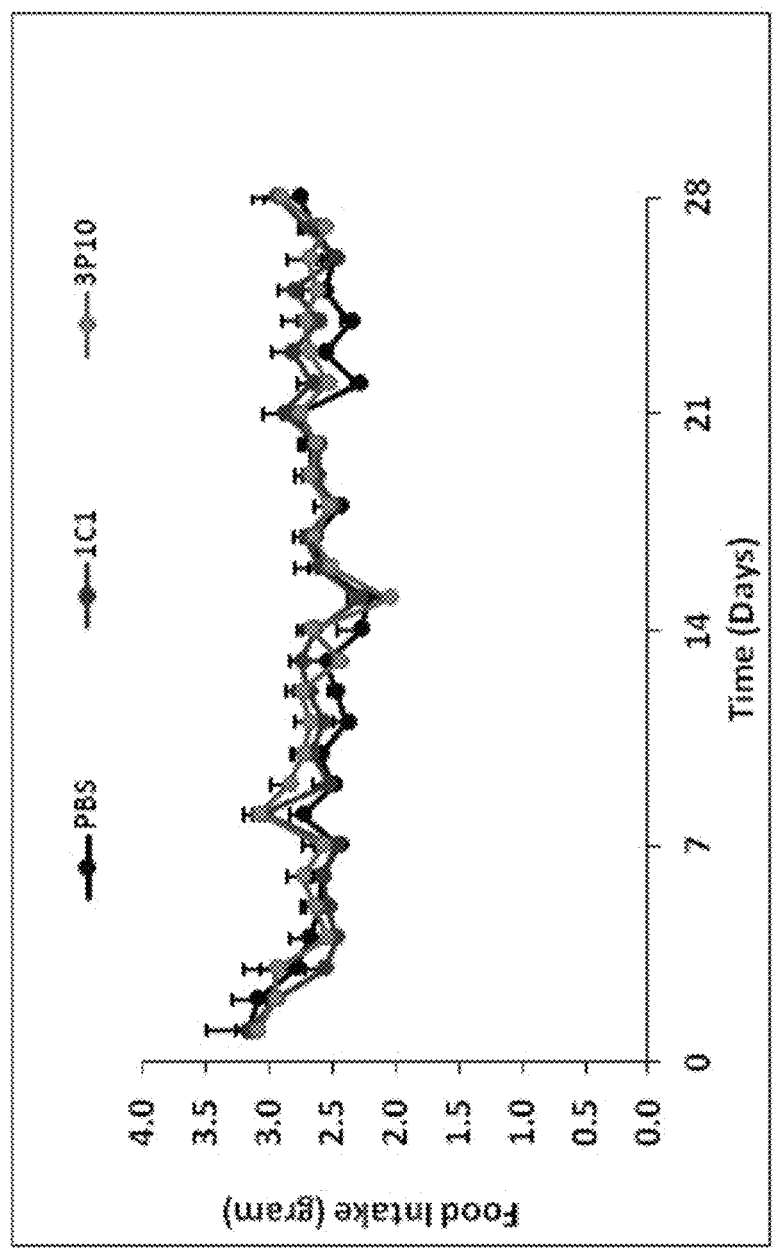
FIG. 18 depicts results of an experiment showing the effects of anti-GFRAL antibodies on food intake in DIO mice.
Figure 19:
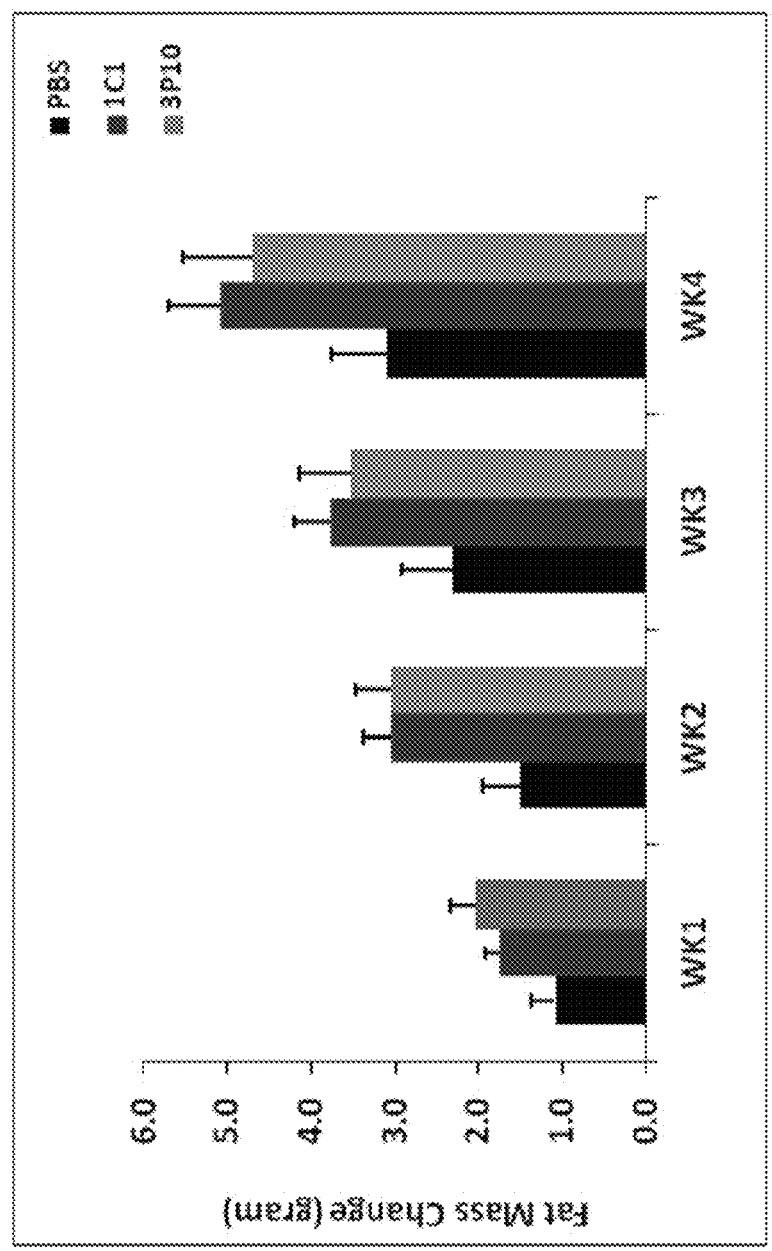
FIG. 19 depicts results of an experiment showing the effects of anti-GFRAL antibodies on fat mass.

Exemplary anti-GFRAL antibodies increased body weight (by 6% and 7%, respectively) and food intake (by 3.4% and 3.7%, respectively) in DIO Mice (FIGS. 17 and 18). The increase in body weight by the exemplary anti-GFRAL antibodies is mainly attributed to increased fat mass (FIG. 19).

C: Anti-GFRAL Antibodies Reverse GDF-15-Induced Loss of Body Mass in DIO Mice

To determine if an exemplary anti-GFRAL antibody is able to neutralize the GDF15-induced weight lowering effect in DIO mice, 17 week old male C57BL/6J DIO mice were used (Jackson Labs West, Sacramento, Calif.) and a recombinant adeno-associated virus (rAAV) expressing GDF15 was constructed.

Construction of the rAAV was performed as follows: Polymerase chain reactions (PCR) reagents kits with Phusion® high-fidelity DNA polymerase were purchased from New England BioLabs (F-530L, Ipswich, Mass.). The PCR reactions were set up according to manufacturer's instruction. Amplified DNA fragments containing an Igk signal peptide followed by a GDF15 encoding sequence was digested with restriction enzymes Spe I and Not I (the restriction sites were included in the 5' or 3' PCR primers, respectively) and were then ligated with AAV transgene vectors that had been digested with the same restriction enzymes. The vector used for expression contained a selectable marker and an expression cassette composed of a strong eukaryotic promoter 5' of a site for insertion of the cloned coding sequence, followed by a 3' untranslated region and bovine growth hormone polyadenylation tail.

The DIO mice were subjected to a high fat diet (Research Diets, catalog # D12492NI). The high fat diet contained 60 kcal % fat, 20 kcal % protein and 20 kcal % carbohydrate. The mice were administered a one-time tail vein injection of the rAAV described above or a control AAV vector expressing green fluorescent protein (GFP). 42 days post injection with rAAV expressing the GDF15 at $1 \times 10^{10}$, mice were administered the exemplary anti-GFRAL antibody (3P10) or a control antibody (anti-KLH antibody) at a dose of 3 mg/kg. There were 20 mice per group. Mice body weight, lean and fat mass, energy expenditure and food intake were monitored over 12 weeks.

Figure 20:
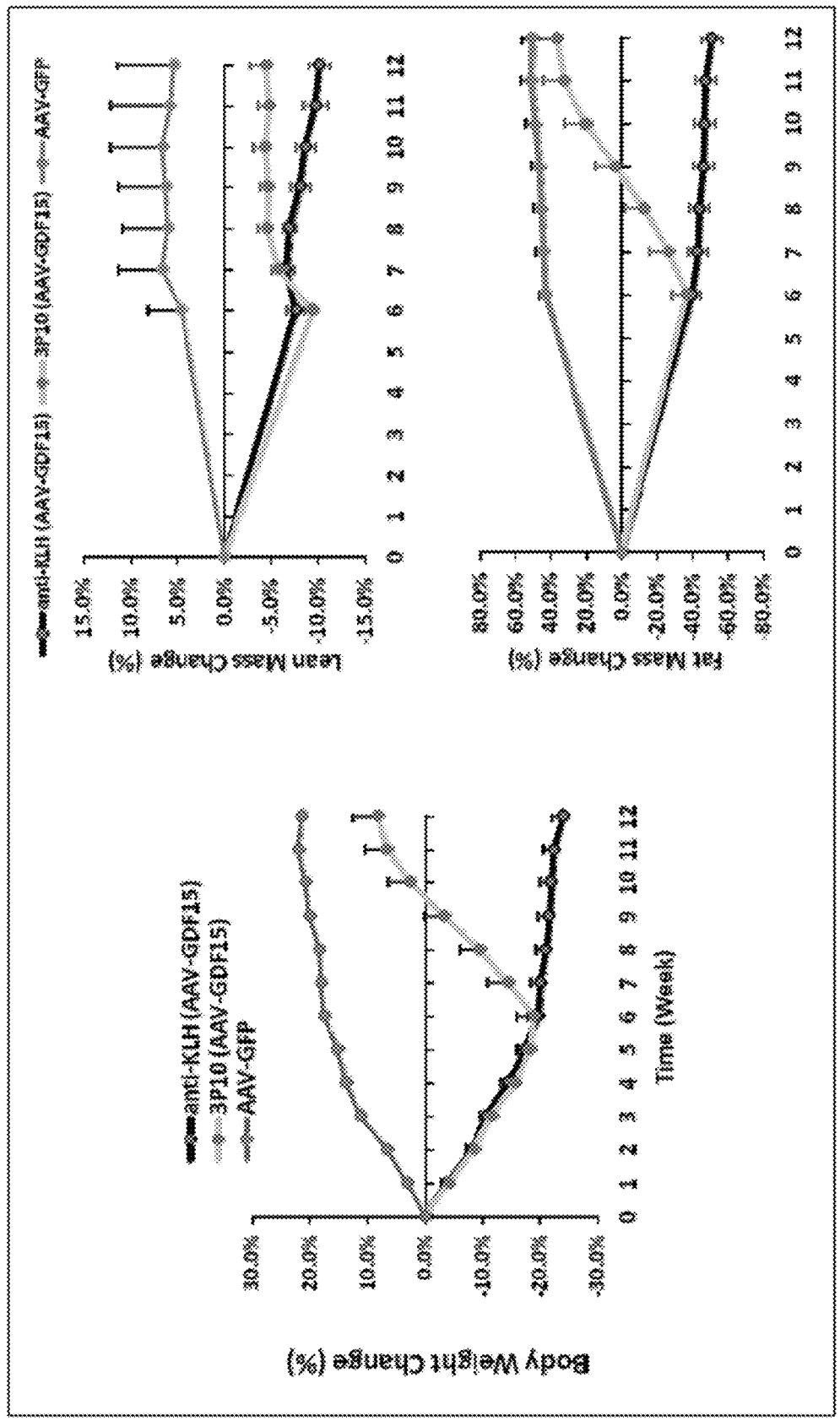
FIG. 20 depicts results of an experiment showing the effect of anti-GFRAL antibodies on GDF15-induced loss of body weight and loss of fat and lean mass in DIO mice.
Figure 21:
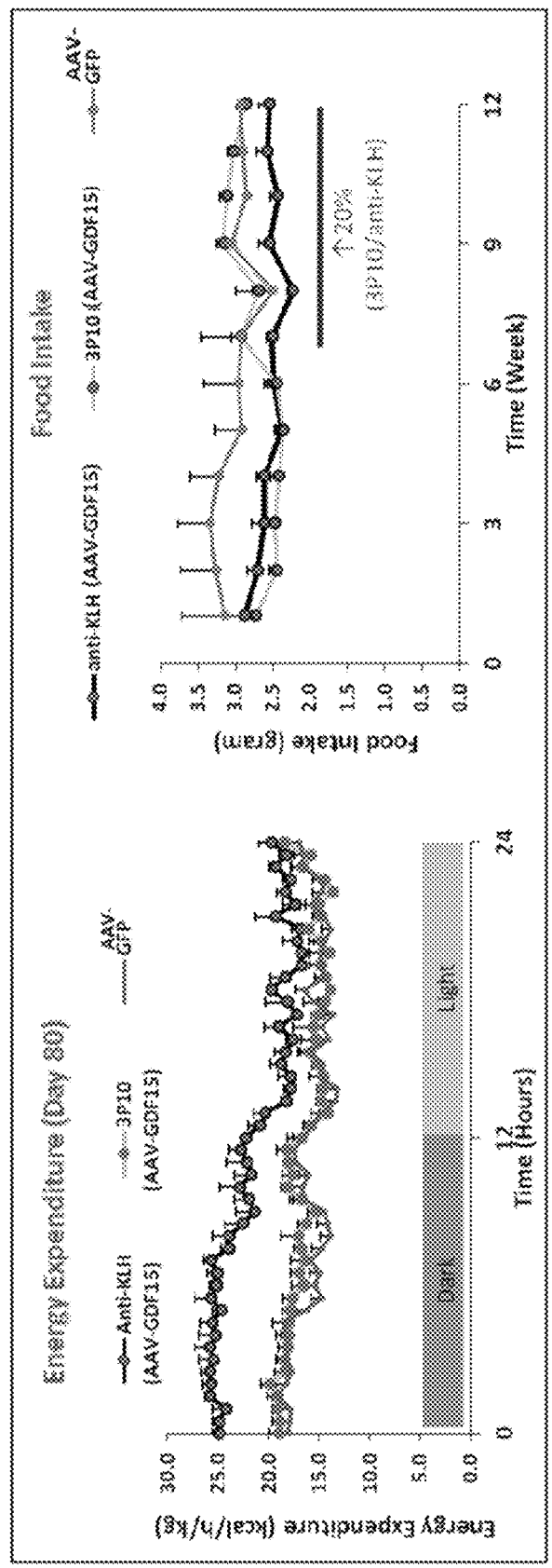
FIG. 21 depicts results of an experiment showing the effects of anti-GFRAL antibodies on GDF15-induced increase in energy expenditure and GDF15-induced reduction in food intake in DIO mice.

As shown in FIG. 20, the exemplary anti-GFRAL antibody (3P10) reversed the GDF15-induced loss of body weight and loss of fat and lean mass in DIO mice. Additionally, as shown in FIG. 21, the exemplary anti-GFRAL antibody reversed the GDF15-induced increase in energy expenditure and GDF15-induced reduction in food intake.

D: Anti-GFRAL Antibodies Reverse GDF-15-Induced Loss of Body Mass in Lean Mice (Chronic)

To determine if an exemplary anti-GFRAL antibody is able to neutralize the GDF15-induced weight lowering effect in lean mice, 15 week old male C57BL/6J mice were used (Jackson Labs West, Sacramento, Calif.). The mice were placed on a Chow Diet. As described in Example 11, part c, the mice were administered a one-time tail vein injection of the rAAV expressing GDF15 at $1 \times 10^{10}$ or a control AAV vector expressing green fluorescent protein (GFP). 28 days post injection with rAAV expressing the GDF15, mice were administered the exemplary anti-GFRAL antibody (3P10) or a control antibody (anti-KLH antibody) at a dose of 3 mg/kg. There were 20 mice per group. Mice body weight, lean and fat mass, energy expenditure and food intake were monitored over 12 weeks.

Figure 22:
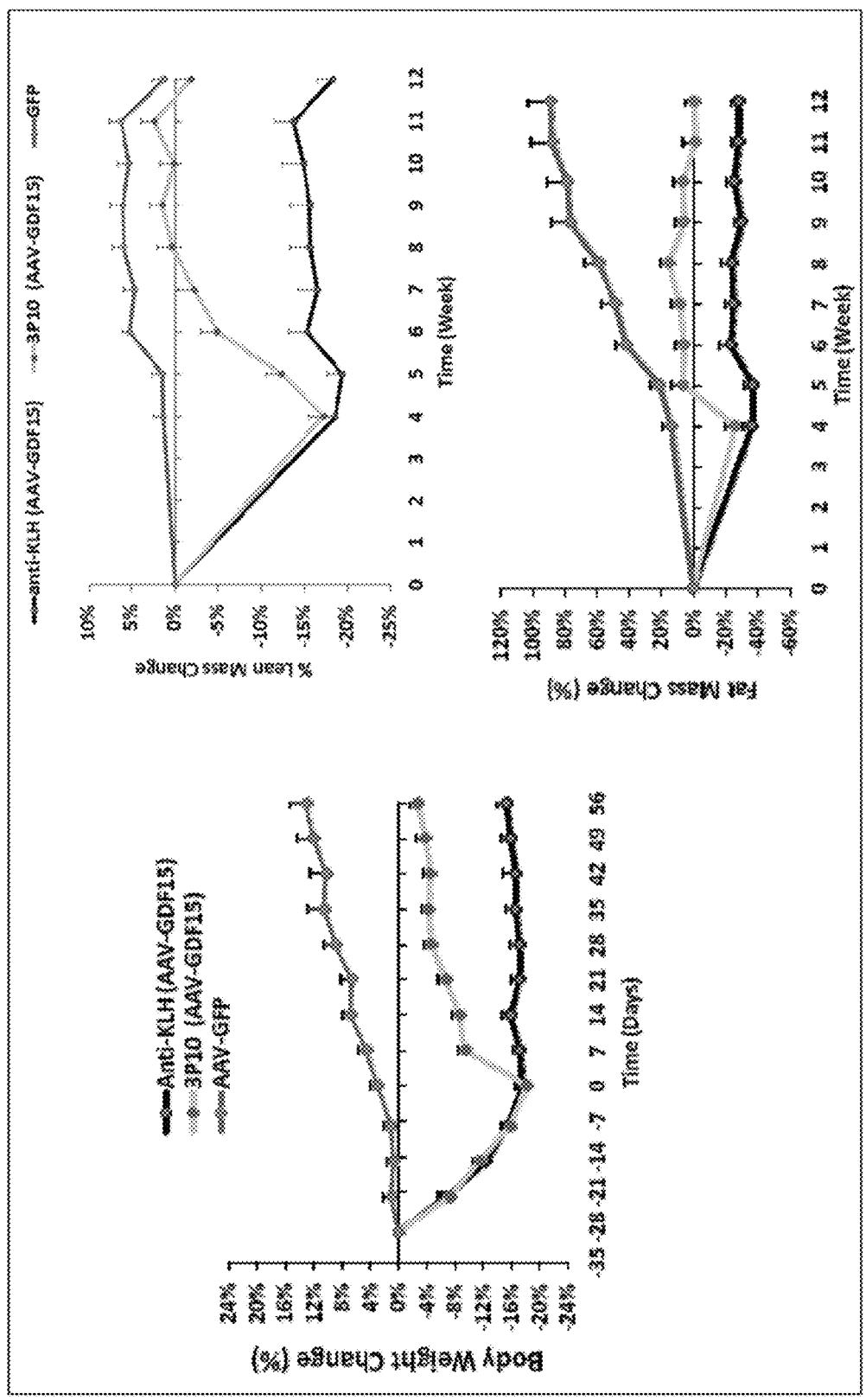
FIG. 22 depicts results of an experiment showing the effects of anti-GFRAL antibodies on GDF15-induced loss of body weight and loss of fat and lean mass in lean mice.
Figure 23:
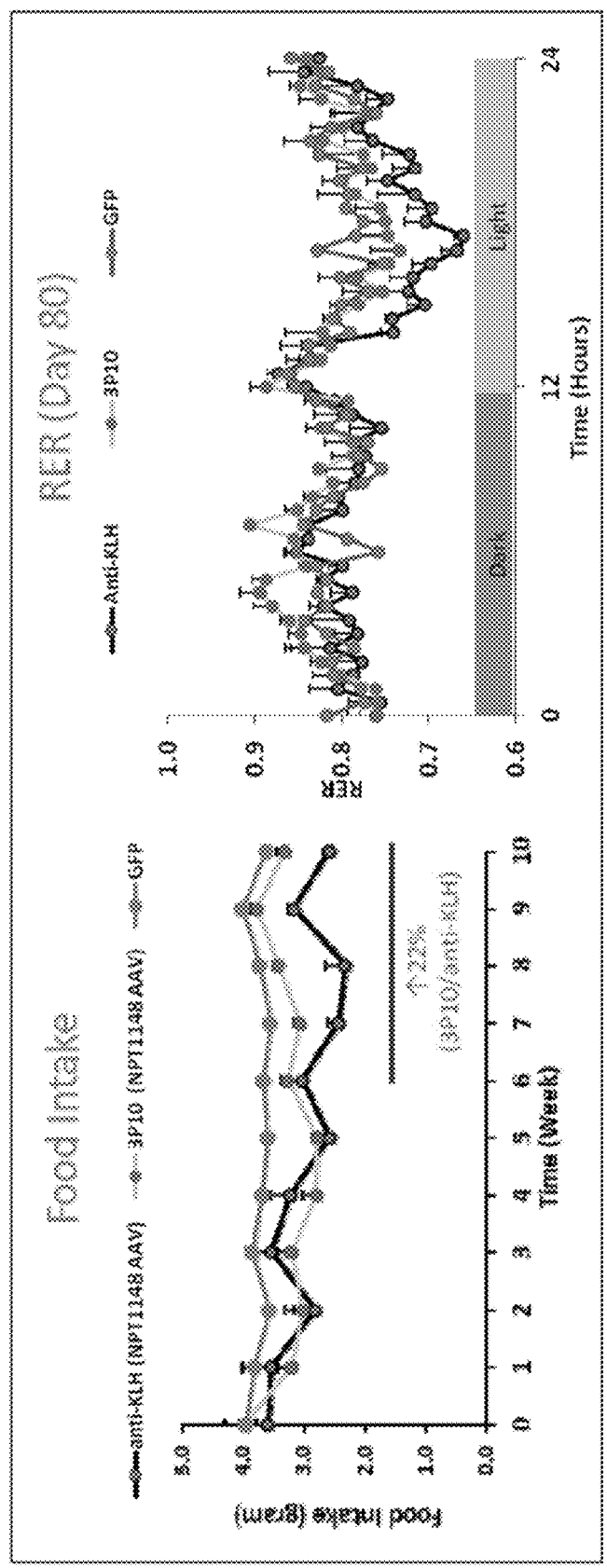
FIG. 23 depicts results of an experiment showing the effects anti-GFRAL antibodies on GDF15-induced change in RER and GDF15-induced reduction in food intake in lean mice.

As shown in FIG. 22, the exemplary anti-GFRAL antibody reversed the GDF15-induced loss of body weight, which included a reversal of both loss of fat mass and loss of lean mass in lean mice. Additionally, as shown in FIG. 23, the exemplary anti-GFRAL antibody reversed the GDF15-induced change in respiratory exchange ratio (RER) and GDF15-induced reduction in food intake in lean mice.

E: Anti-GFRAL Antibodies do not Increase Body Weight Independent of GDF15-Induced Weight Loss in Lean Mice To determine if an exemplary anti-GFRAL antibody is able to increase body weight independent of exogenous GDF15 protein in lean mice, 15 week old male C57BL/6J mice were used (Jackson Labs West, Sacramento, Calif.). Mice (26.1 g±0.3 g) were randomly assigned to receive either PBS or an exemplary anti-GFRAL antibody (e.g., 1C1 or 3P10) at 10 mg/kg weekly. Each group had 10 mice per group. Daily food intake and body weight were recorded in the first week, and then recorded weekly for another 3 weeks. Sartorius balance LE5201 was used for weighing.

Figure 24:
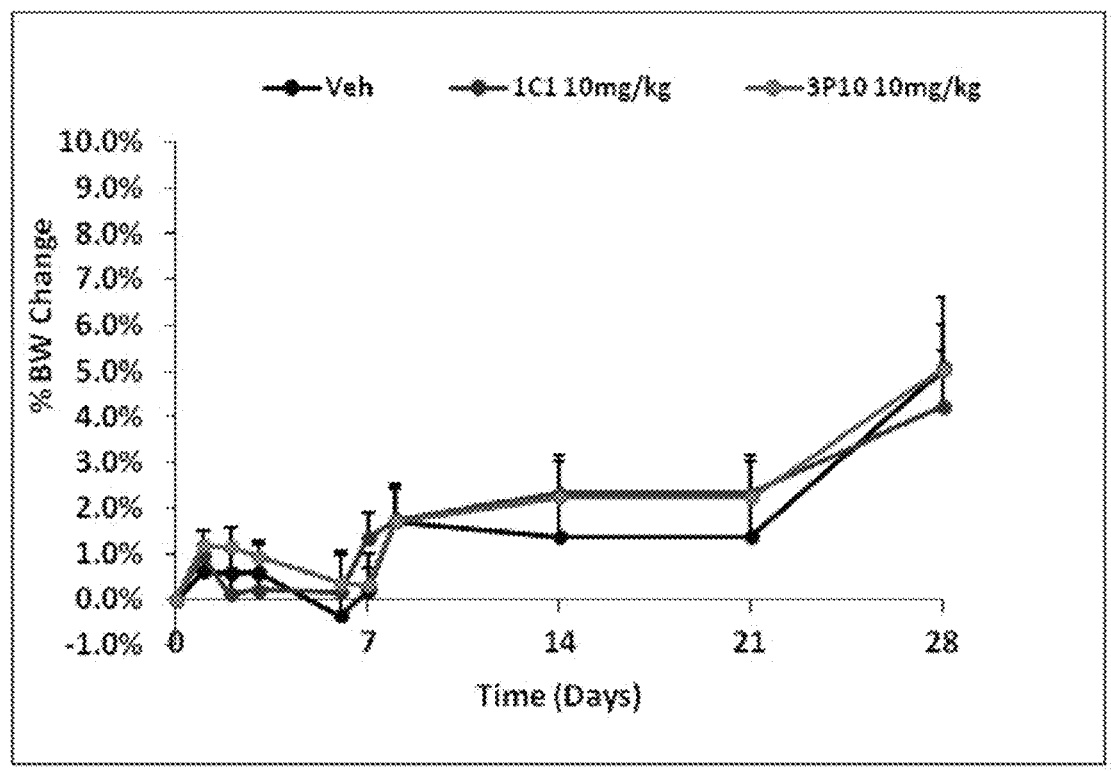
FIG. 24 depicts results of an experiment showing the effects of an anti-GFRAL antibody (3P10) on body weight in lean mice.
Figure 25:
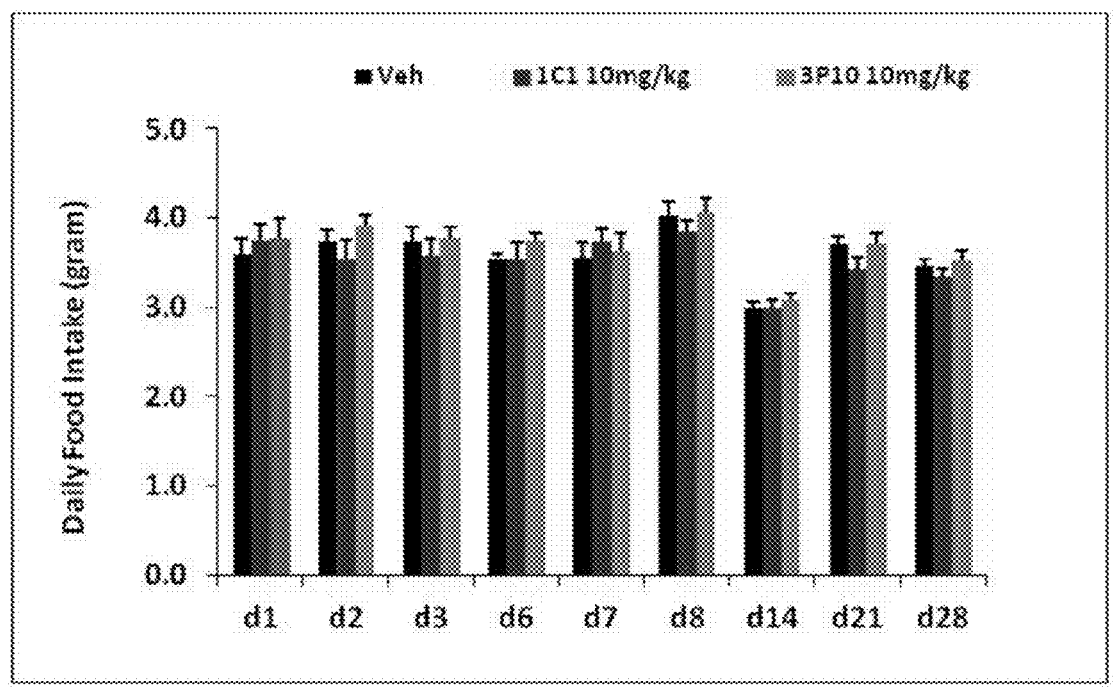
FIG. 25 depicts results of an experiment showing the effects of administration of anti-GFRAL antibodies on food intake in lean mice.

Repeat doses of exemplary anti-GFRAL antibodies 1C1 and 3P10 do not significantly alter body weight and food intake in lean mice, although antibody 3P10 showed a weak trend to increase body weight (FIGS. 24 and 25).

F: Anti-GFRAL Antibodies Reverse Body Weight Loss and Increased Energy Expenditure in Mice with Chronic Kidney Damage To determine if an exemplary anti-GFRAL antibody is able to reverse loss of body weight and increased energy expenditure in DIO mice with chronic kidney damage, 15 week old male C57BL/6J mice were used (Jackson Labs West, Sacramento, Calif.). After 5 weeks on HFD+adenine diet (0.3% @ induction phase for 10 days, then reducing to 0.1% @ maintenance phase for another 3 weeks), DIO Mice (26.1 g±0.3 g) were randomly assigned to receive either control antibody (anti-KLH) or exemplary anti-GFRAL antibodies (e.g., 3P10) at 1 mg/kg weekly. Each group had 12 mice per group. Daily body weight was recorded in the first week, and then recorded weekly for another 8 weeks. Sartorius balance LE5201 was used for weighing.

As shown in FIG. 26A, in order to verify the effect of adenine on kidney function, 10-day treatment with dietary adenine (0.25% adenine in HFD) was shown to induce kidney damage in mice. Dietary adenine also increased serum GDF15 levels (see FIG. 26B) and promoted weight loss (see FIG. 26C). Additionally, dietary adenine increased energy expenditure in mice (see FIG. 27A).

Figures 27A, 27B:
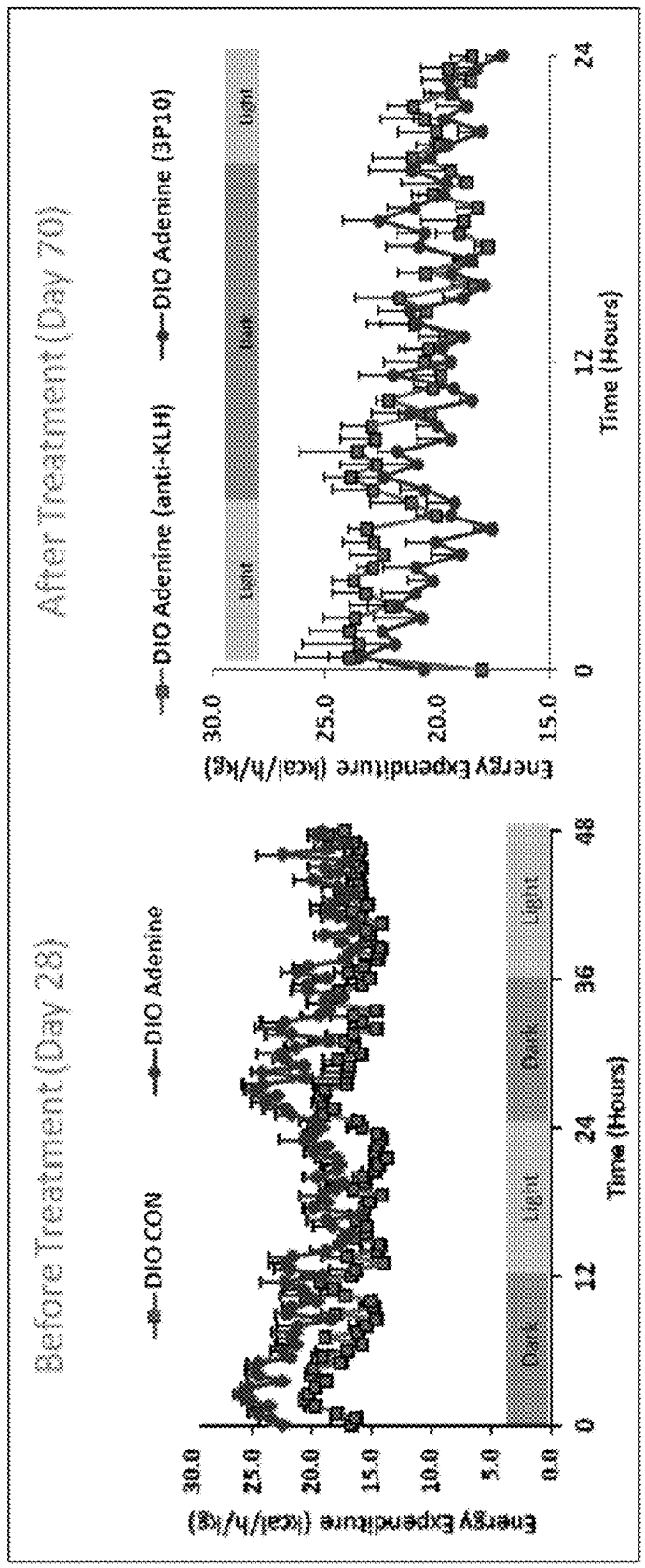
FIG. 27A depicts results of an experiment showing the effects of dietary adenine.
FIG. 27B depicts results of an experiment showing the effects of an exemplary an anti-GFRAL antibody (3P10) on mice with chronic kidney damage.
Figure 28:
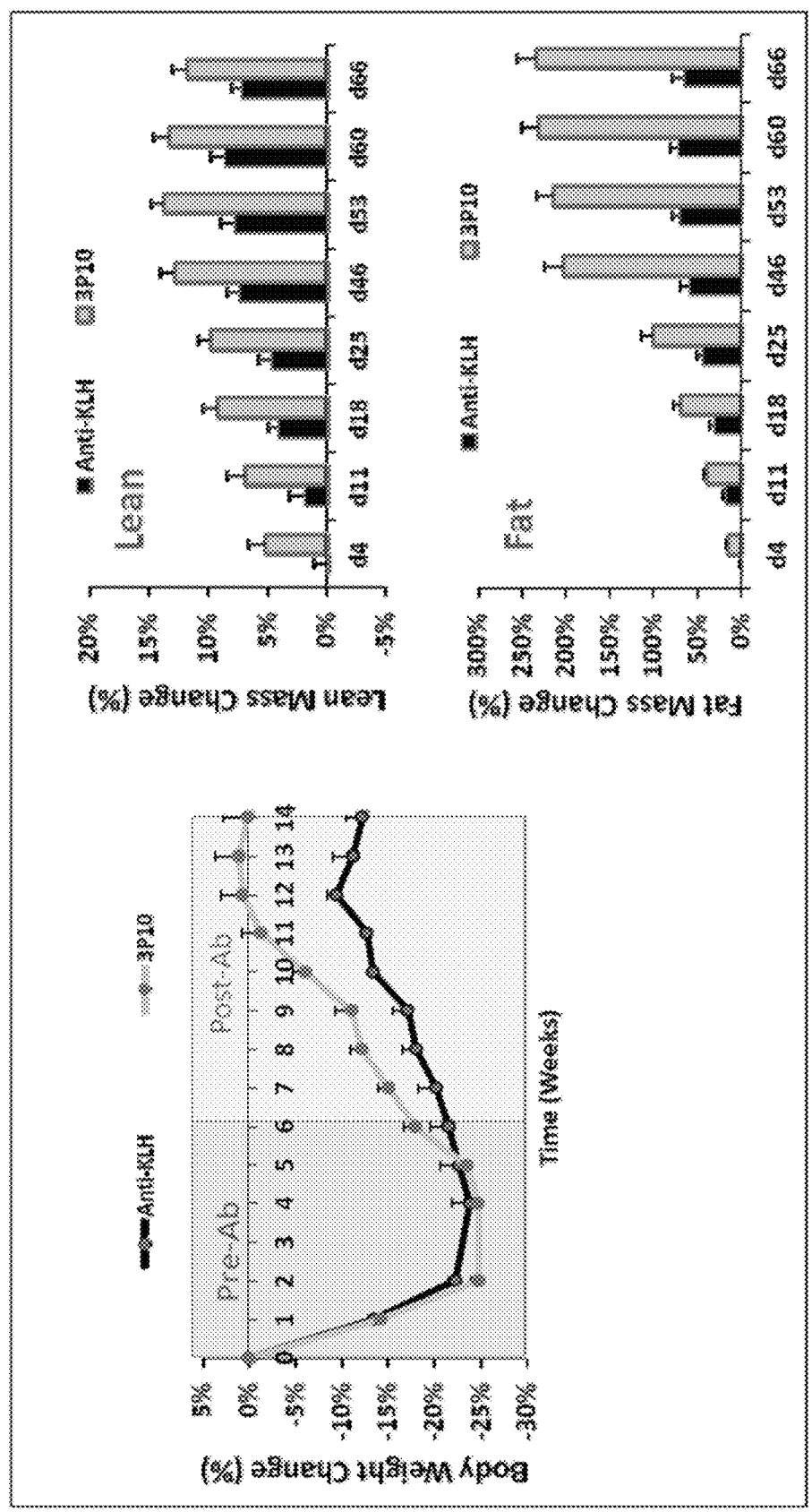
FIG. 28 depicts results of an experiment showing the effects of an exemplary an anti-GFRAL antibody (3P10) on mice with chronic kidney damage.

As shown in FIG. 27B, the exemplary anti-GFRAL antibody reversed the increased energy expenditure in mice with chronic kidney damage. Additionally, as shown in FIG. 28, the exemplary anti-GFRAL antibody reversed the loss of body weight and loss of fat and lean mass in mice with chronic kidney damage.

G: Humanized Anti-GFRAL Antibodies Inhibit GDF15-Induced Weight Loss in a Dose-Dependent Manner To determine if an humanized anti-GFRAL antibody is able to neutralize the GDF15-induced weight lowering effect in diet-induced obesity (DIO) mice, 17 week old male C57BL/6J DIO mice were used (Jackson Labs West, Sacramento, Calif.). Initially mice (42 g±0.4 g) were randomly assigned to PBS (8 mice per group) or a GDF15 protein (56 mice per group). A GDF15 protein was confirmed to reduce body weight and food intake dose-dependently in the following day. Furthermore, 8 mice per group were randomly assigned to receive either an vehicle (anti-KLH) or an exemplary mouse anti-GFRAL antibody (e.g., m3P10) at a dosage of 1.0 mg/kg, or an exemplary humanized anti-GFRAL antibody (e.g., h3P10=HC-344e+LC-344h) at dosages of 0.1 mg/kg, 0.3 mg/kg, 1.0 mg/kg, 3 mg/kg or 10 mg/kg. Daily body weight was recorded (day 1-7). Sartorius balance LE5201 was used for weighing. An automatic weighing record program (Sartorius YSW05 Software Wedge, Sartorius Mechatronics Corporation, 5 Orville Drive, Suite 200 Bohemia, N.Y. 11716) was used to transmit the weight data to a Microsoft Excel spreadsheet automatically.

Data are presented by mean±sem in term of delta body weight change. A Student's t-test was used (two tails, two ends).

Figure 29:
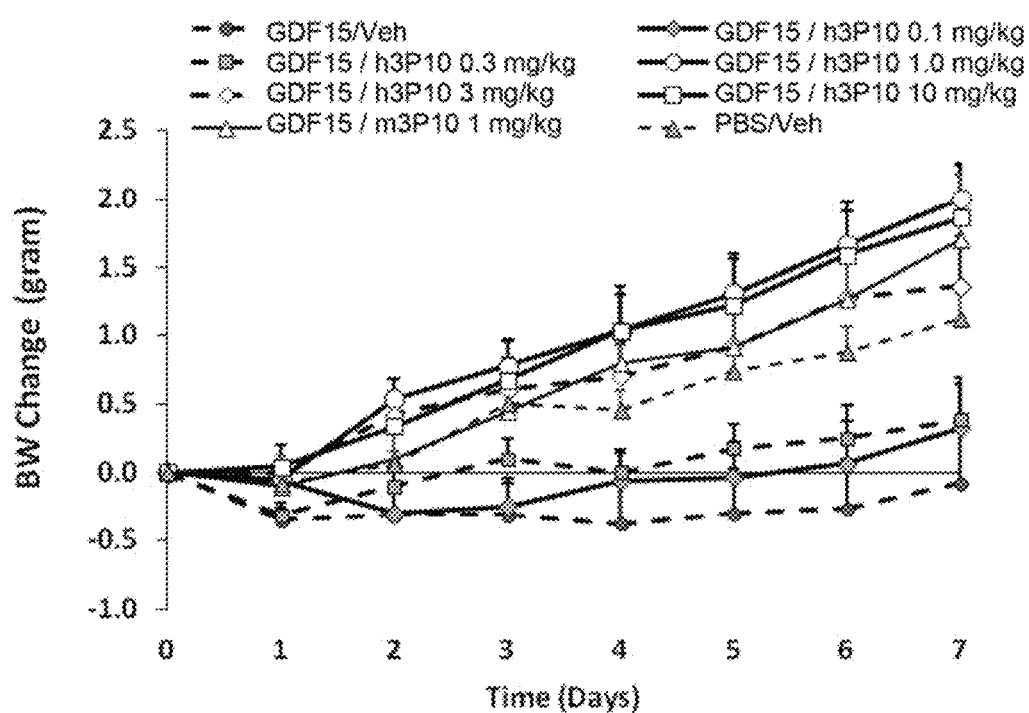
FIG. 29 depicts results of an experiment showing the effects of an exemplary humanized anti-GFRAL antibody (h3P10) of GDF15-induced body weight loss.

Exemplary humanized anti-GFRAL antibody HC-344e+ LC-344h is able to inhibit GDF15-induced body weight loss in a dose-dependent manner (FIG. 29).

Example 11: Crystal Structure of GFRAL/GDF15 Complex

A: Complex Formation and Crystallization

A complex of a GFRAL protein and a GDF15 protein was made by mixing 1.2 molar excess of a GFRAL (W115-E351) protein with 1 molar GDF15 protein subunit (0.5 molar GDF15, which is a homodimer of two GDF15 subunits linked by a pair of disulfide bonds). The complex was purified by size exclusion chromatography to remove excess GFRAL. The GFRAL/GDF15 complex was crystallized by mixing 1 μL protein at 5 mg/ml with 0.5 μL reservoir solution and 0.5 μL seed in a crystallization drop, with the reservoir solution containing 1.0 mL of 0.1 M Bis-Tris pH 6.0, 1.5 M $(NH_4)_2SO_4$ and 10% ethylene glycol. The seed crystals were obtained from a crystallization condition including a reservoir solution of 0.1 M Bis-Tris pH 6.0 and 1.5 M $(NH_4)_2SO_4$. The crystallization setup was kept at room temperature in Rigaku 24 well clover leaf plate. The crystallization drop showed small needle crystals after three days of incubation.

Figure 30:
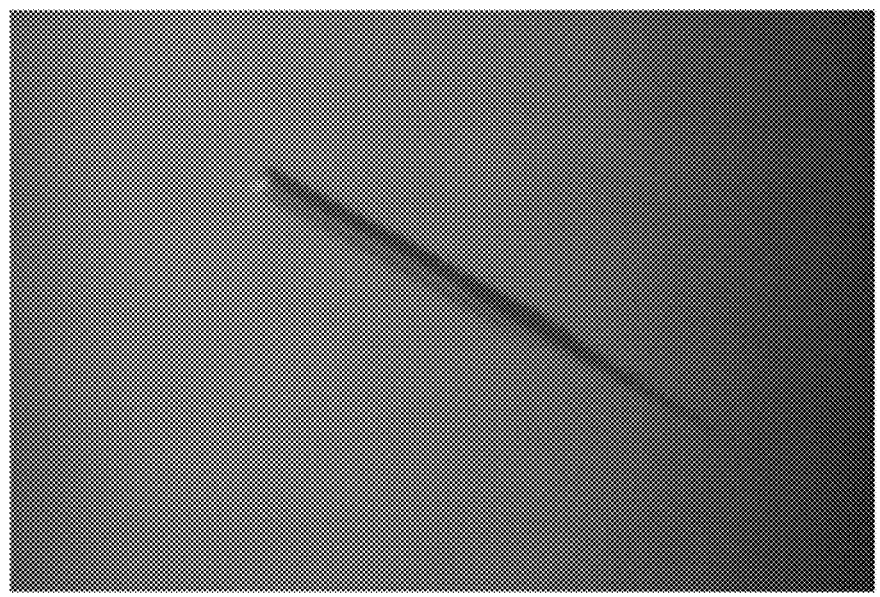
FIG. 30 shows an exemplary crystal of a complex of a GFRAL protein and a GDF15 protein.

An exemplary small needle crystal of a comples of a GFRAL protein and a GDF15 protein is shown in FIG. 30.

The molecular model was not available for GFRAL, hence NaBr soaking was used to determine crystal phasing. A GFRAL/GDF15 crystal obtained as described above was soaked with 0.5 M NaBr and 0.75 M NaBr containing reservoir solution. After 30 minutes, 0.5 M NaBr soaked crystals were in good condition, whereas 0.75 M NaBr soaking yielded cracked crystals. Crystals from both soaks and un-soaked crystals were mounted with 30% EG as a cryo-protectant.

The model described herein provides the first structural information for a GFRAL protein and the binding of a GFRAL protein to a GDF15 protein.

B: Data Collection and Structure Determination

GFRAL/GDF15 complex crystals were obtained and harvested from a 0.1 M Bis-Tris pH 6.0, 1.5 M $(NH_4)_2SO_4$ and 10% ethylene glycol reservoir condition as soaked and unsoaked crystals from 0.5 M and 0.7 M NaBr soaks. The crystals were treated with the mother liquor supplemented with 20% ethylene glycol as cryoprotectant and flash-frozen in liquid nitrogen. These crystals were then examined for x-ray diffraction at the synchrotron beamline IMCA-CAT, Advanced Photon Source, Argonne National Lab (ALS). The crystal diffracted up to 2.28-2.20 Å resolution.

X-ray diffraction statistics for exemplary GFRAL/GDF15 complex crystals are shown in Table 36.

TABLE 36

| Data collection statistics | Crystal I |
|---|---|
| Wave length | 0.9786 Å |
| Space group | $P2_1$ |
| Unit cell (Å) | a = 75.352 |
| | b = 88.768 |
| | c = 121.293 |
| Resolution (Å)[†] | 50-2.20 |
| | (2.28-2.20) |
| Number of measurements | 118,710 |
| Number of unique reflections | 20,379 |
| $R_{sym}$ (%)[†] | 0.09 (0.58) |
| Completeness (%)[†] | 97.4 (85.4) |
| I/σ [†] | 18.9 (2.2) |
| Redundancy[†] | 5.8 (4.9) |
| Molecules in the A.U. | 1 GFRAL |
| | 1 GDF15 |

[†]The parenthesis is for the highest resolution shell in A.

Molecular replacement of GFRAL/GDF15 was performed by using the scaled dataset with a previously solved GFRAL/GDF15 complex at 3.2 Å resolutions as a starting model and the rigid body refinement (See Vagin, A. A., et al., (2004) "REFMAC5 dictionary: Organization of prior chemical knowledge and guidelines for its use." Acta Crystallogr. D 60:2284-2295) and initial positional refinement was completed in REFMAC5 as implemented in CCP4. Several rounds of model rebuilding resulted in structures of the GFRAL/GDF15 complex.

Exemplary structures of a complex of a GFRAL protein and a GDF15 protein are shown, for example, in FIG. 31-39B.

Inspection of the initial electron density maps showed unambiguous density for GFRAL and GDF15. After rigid body refinement, several rounds of model building and restrained refinement were performed using COOT (See Emsley, P. and Cowtan, K. (2004) "COOT: model-building tools for molecular graphics." Acta Crystallogr. D 60:2126-2132). After placement of the solvent molecules final refinement was completed.

The atomic coordinates from the x-ray diffraction patterns for the GFRAL/GDF15 complex are found in Table 49.

Refinement statistics for exemplary crystals are shown in Table 37.

TABLE 37

| Refinement Statistics | |
|---|---|
| Refinement Range (Å) | 35.82-2.20 |
| $R_{cryst}$ (%) | 20.1 |
| $R_{free}$ (%) | 26.2 |
| Molecules GDF15, GFRAL; Water molecules | 1,1; 132 |
| Bond lengths (Å) | 0.019 |
| Bond angles (°) | 1.943 |
| Average B-factors (Å$^2$) | Overall |
| Main chain atoms (GDF15, GFRAL) | 43.9, 57.6 |
| Side chain atoms (GDF15, GFRAL) | 51.2, 66.8 |
| Water molecules | 56.7 |
| Ramachandran Plot (%) | Overall |
| Favored | 96.3 |
| Allowed | 2.7 |
| Disallowed | 1.0 |

Figure 31:
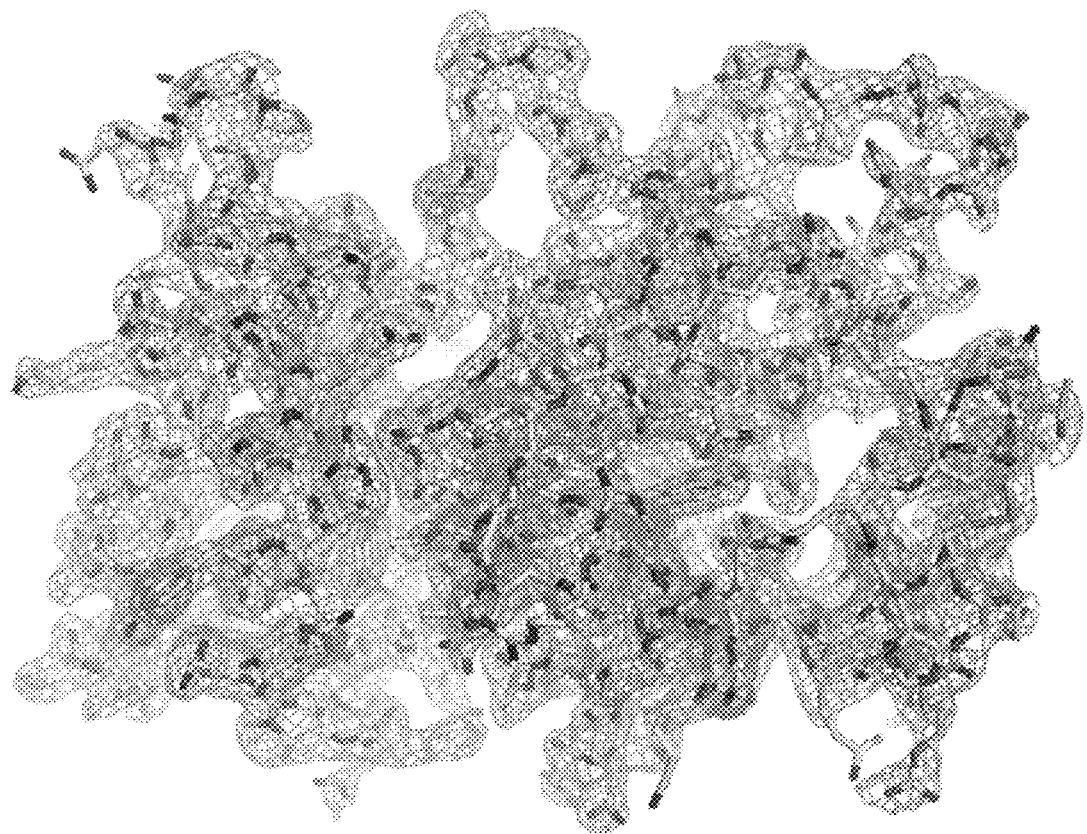
FIG. 31 illustrates an exemplary GFRAL electron density map.

The clear electron density for GFRAL in an exemplary GFRAL/GDF15 complex crystal is illustrated in FIG. 31. FIG. 31 shows an electron density map (2fo-fc) for the GFRAL molecule calculated with 2.20 Å resolution data and contoured at the 1σ level. The GFRAL residues are clearly visible.

C: Crystal Structure of GFRAL/GDF15 Complex

The crystal structure of a complex of a GFRAL protein and a GDF15 protein was determined.

Core interaction interface amino acids were determined as being the amino acid residues (on a protein such as GFRAL) with at least one atom less than or equal to 4.5 Å from the GFRAL interacting proteins (such as GDF15). 4.5 Å was chosen as the core region cutoff distance to allow for atoms within a van der Waals radius plus a possible water-mediated hydrogen bond.

Boundary interaction interface amino acids were determined as the amino acid residues (on a protein such as GFRAL) with at least one atom less than or equal to 5 Å from core interaction interface amino acids on GFRAL that interact with GFRAL interacting proteins (such as GDF15). Less than or equal to 5 Å was chosen as the boundary region cutoff distance because proteins binding to residues less than 5 Å away from core interaction interface amino acids on GFRAL will be within the van der Waals radius of GFRAL interacting proteins.

Amino acids that met these distance criteria were calculated with the Molecular Operating Environment (MOE) program from CCG (Chemical Computing Group).

Figure 32:
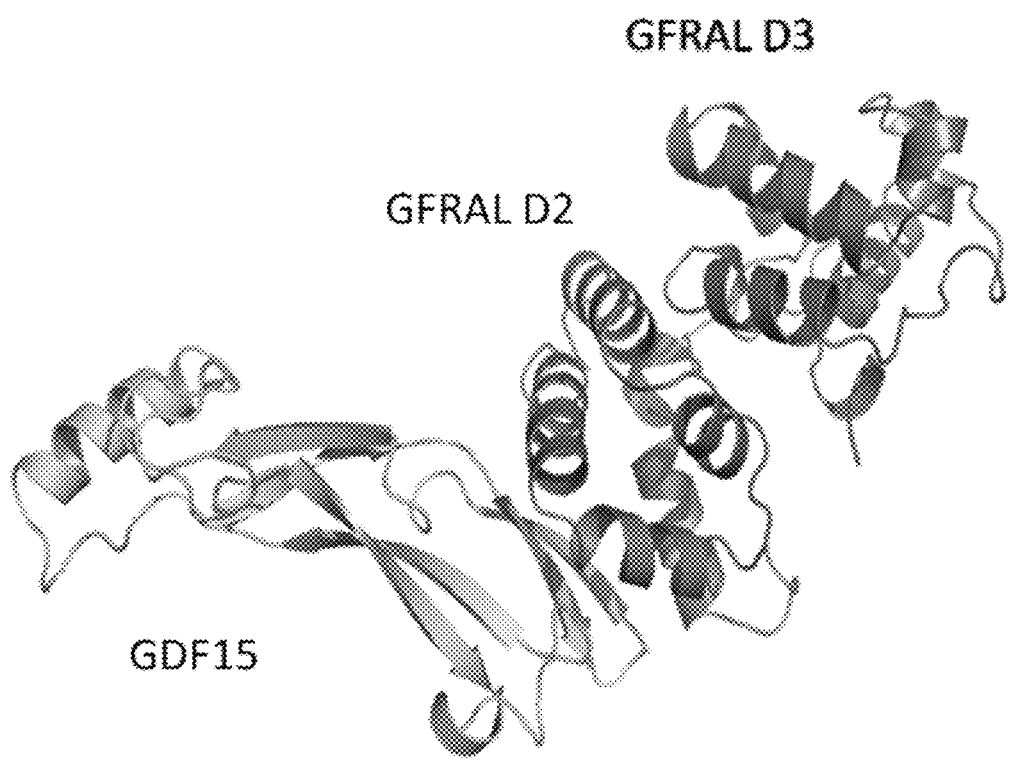
FIG. 32 shows an exemplary ribbon diagram of a GFRAL/GDF15 complex formed in an asymmetric GFRAL/GDF15 crystal unit. GFRAL protein domains D2 and D3 are indicated as GFRAL D2 and GFRAL D3.
Figure 33:
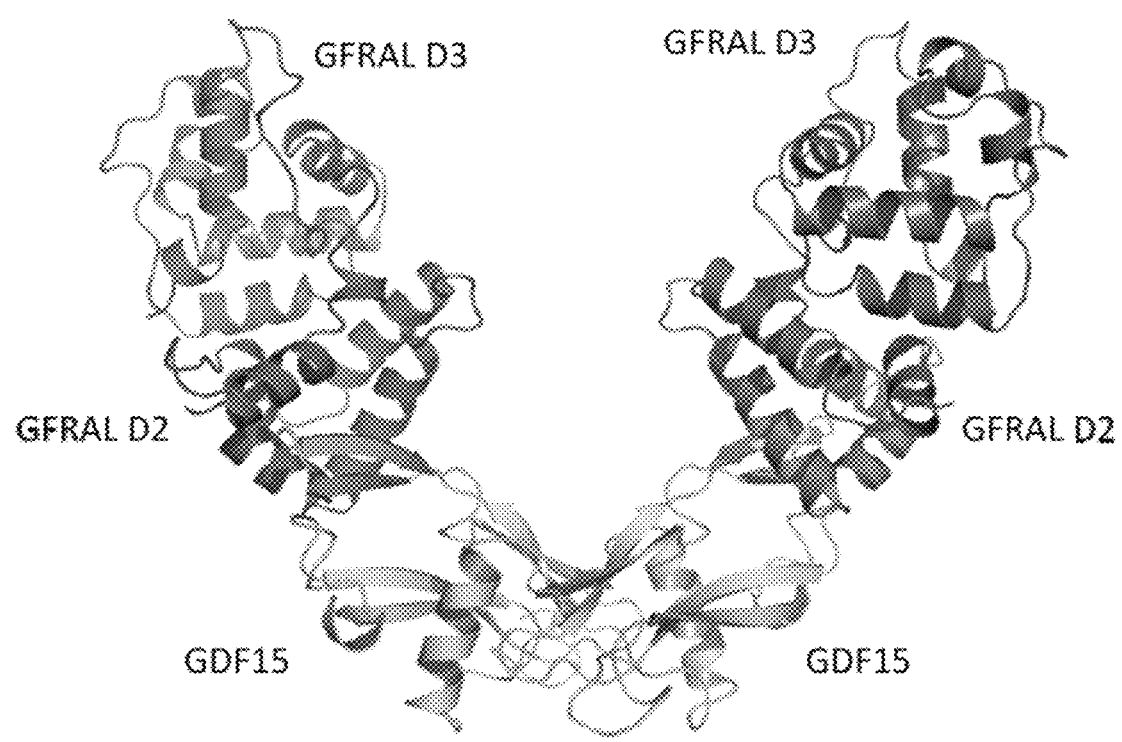
FIG. 33 shows an exemplary ribbon diagram of a dimer of two GFRAL/GDF15 complexes. The GFRAL protein domains D2 and D3 are indicated as GFRAL D2 and GFRAL D3.

FIG. 32 shows an exemplary illustration of a heterodimeric GFRAL/GDF15 complex, as found in the asymmetric unit of a GFRAL/GDF15 protein crystal. The dimeric molecule GDF15 has one intermolecular disulfide link, which was found to be weak due to radiation damage. One side of a GDF15 molecule can form a dimer in the asymmetric unit. FIG. 33 shows an exemplary dimeric arrangement of the GFRAL/GDF15 hetero dimers in a GFRAL/GDF15 crystal.

Figure 34A:
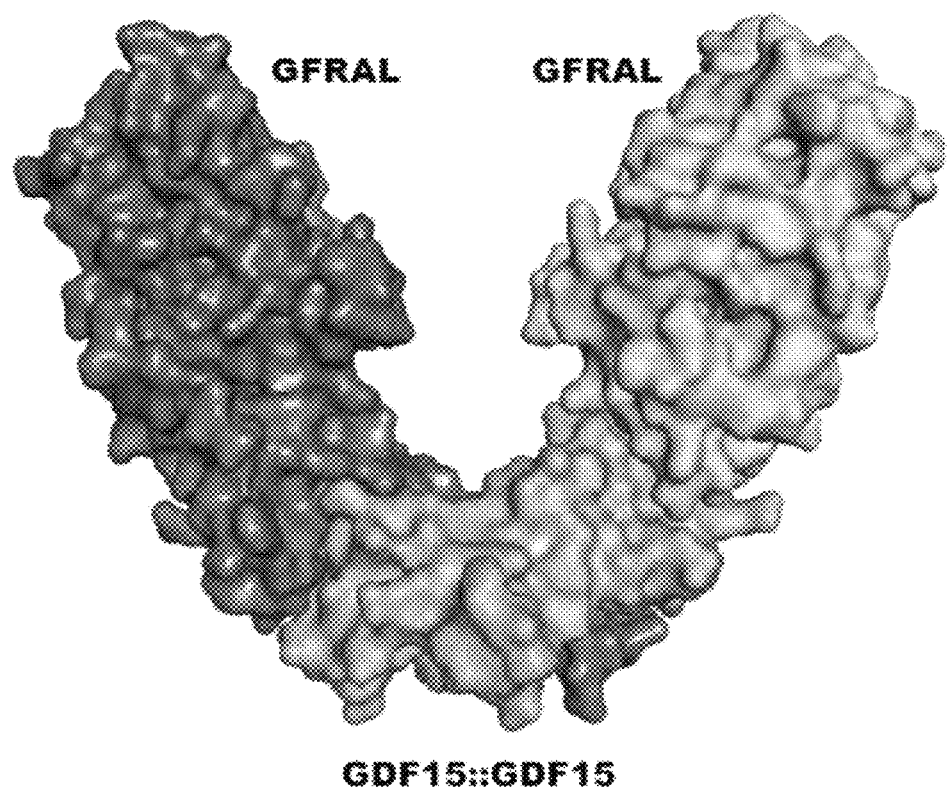
FIGS. 34A-34B show different surface representations of a dimer of two GFRAL/GDF15 complexes.
Figure 34B:
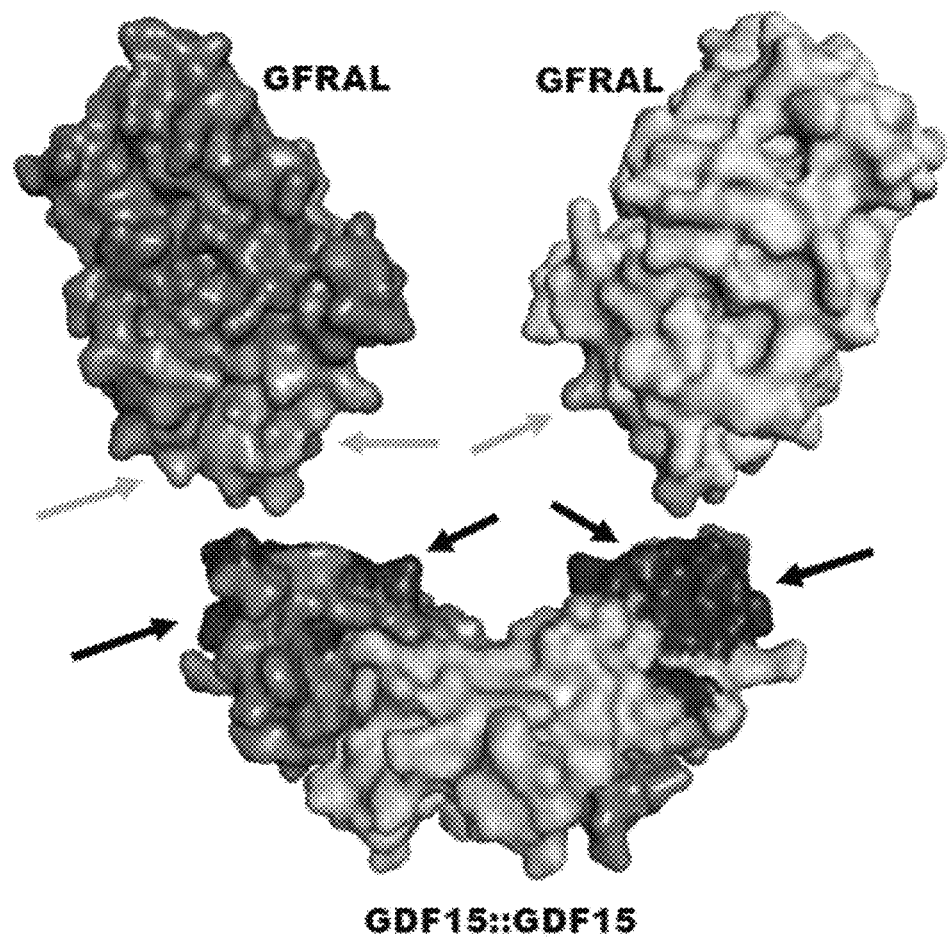

FIG. 34A-34B illustrate the extent of the protein-protein contacts on a GFRAL-GDF15 interface. The contact region on GFRAL is indicated by light gray arrows; the contact region on GDF15 is indicated by the black arrows.

Figure 35:
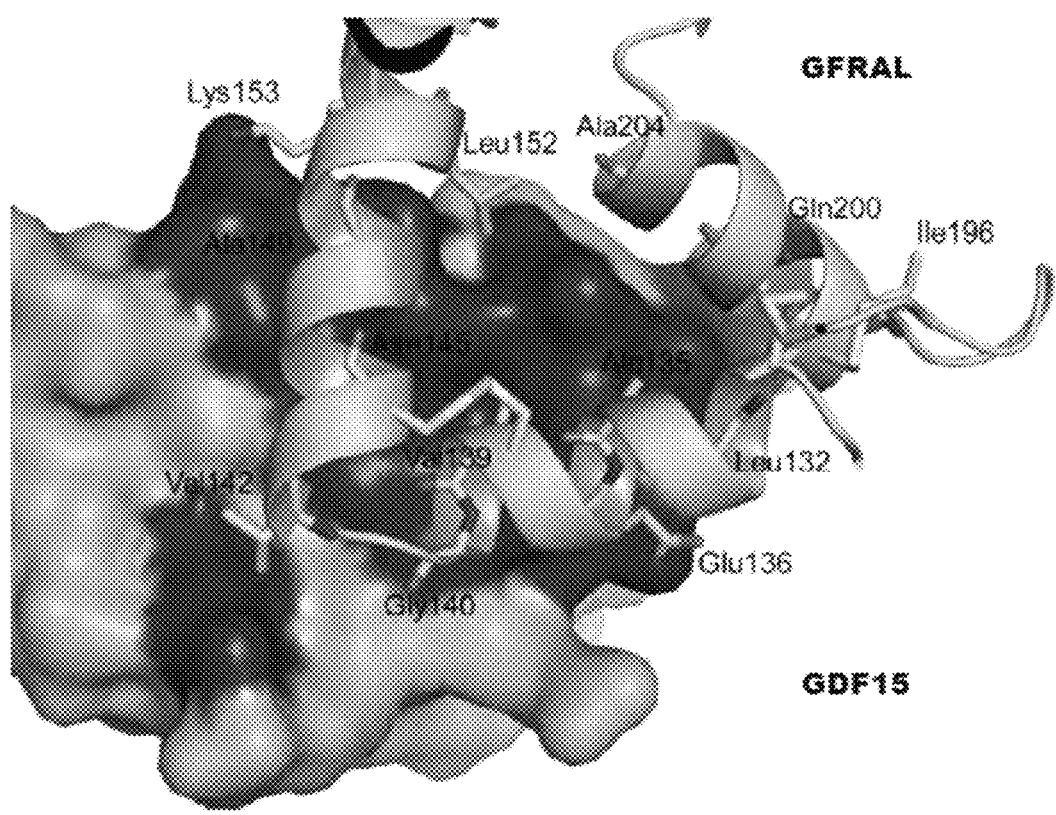
FIG. 35 illustrates GFRAL amino acid residues interacting with GDF15 amino residues.

FIG. 35 shows that three α-helices of GFRAL are involved in a GFRAL/GDF15 interface. Multiple disulfide bridges appear to stabilize the structural arrangement of the three GFRAL α-helices.

Figure 36A:
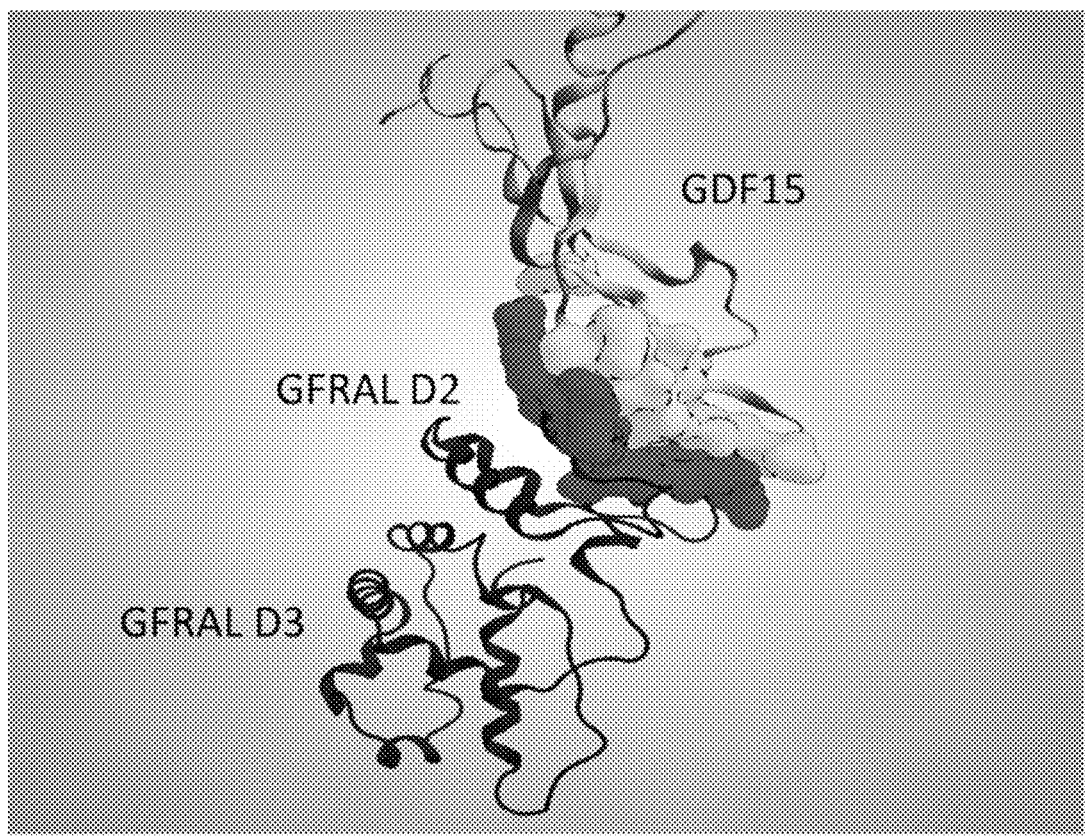
FIGS. 36A-36D illustrate a GFRAL/GDF15 interface. The GFRAL protein domains D2 and D3 are indicated as GFRAL D2 and GFRAL D3.
Figure 36B:
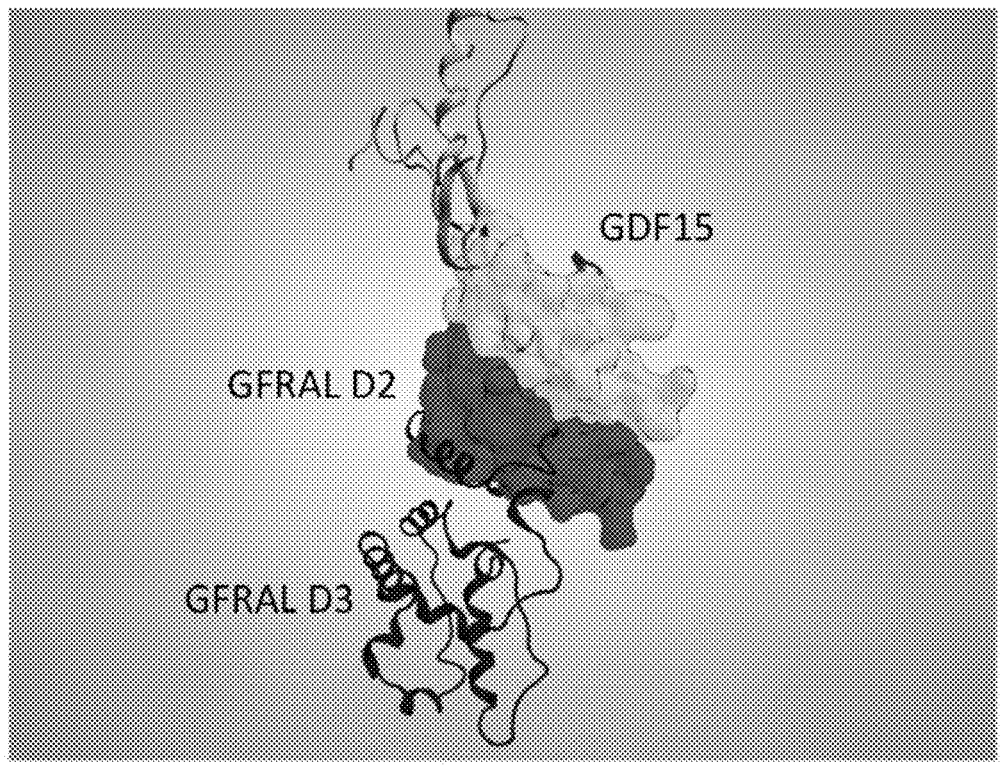
Figure 36C:
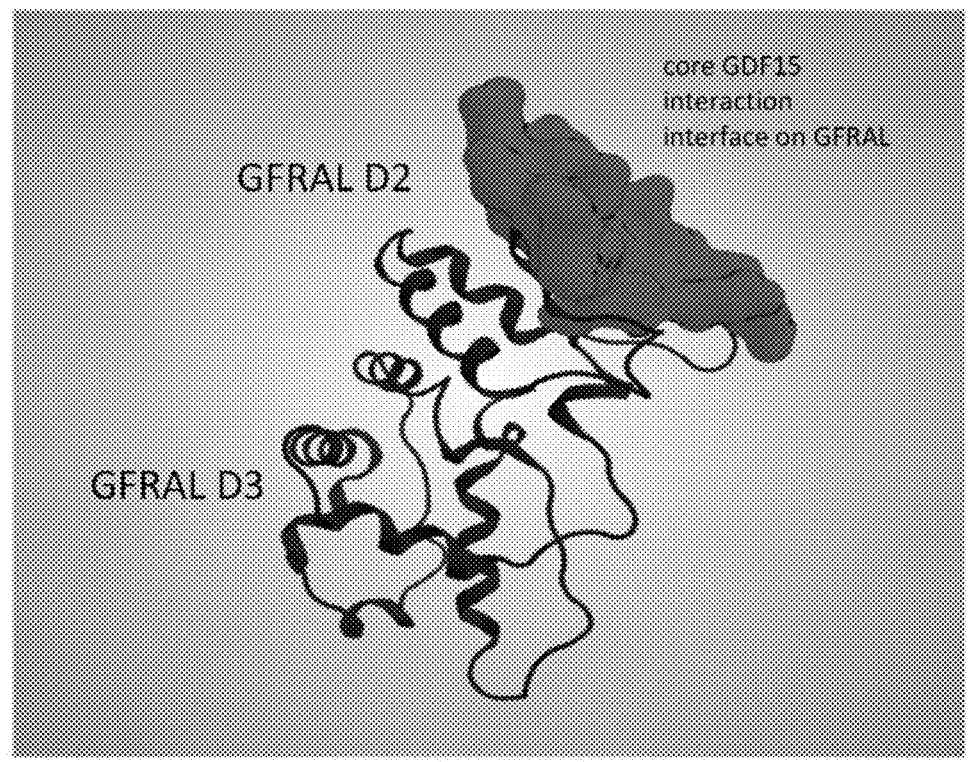
Figure 36D:
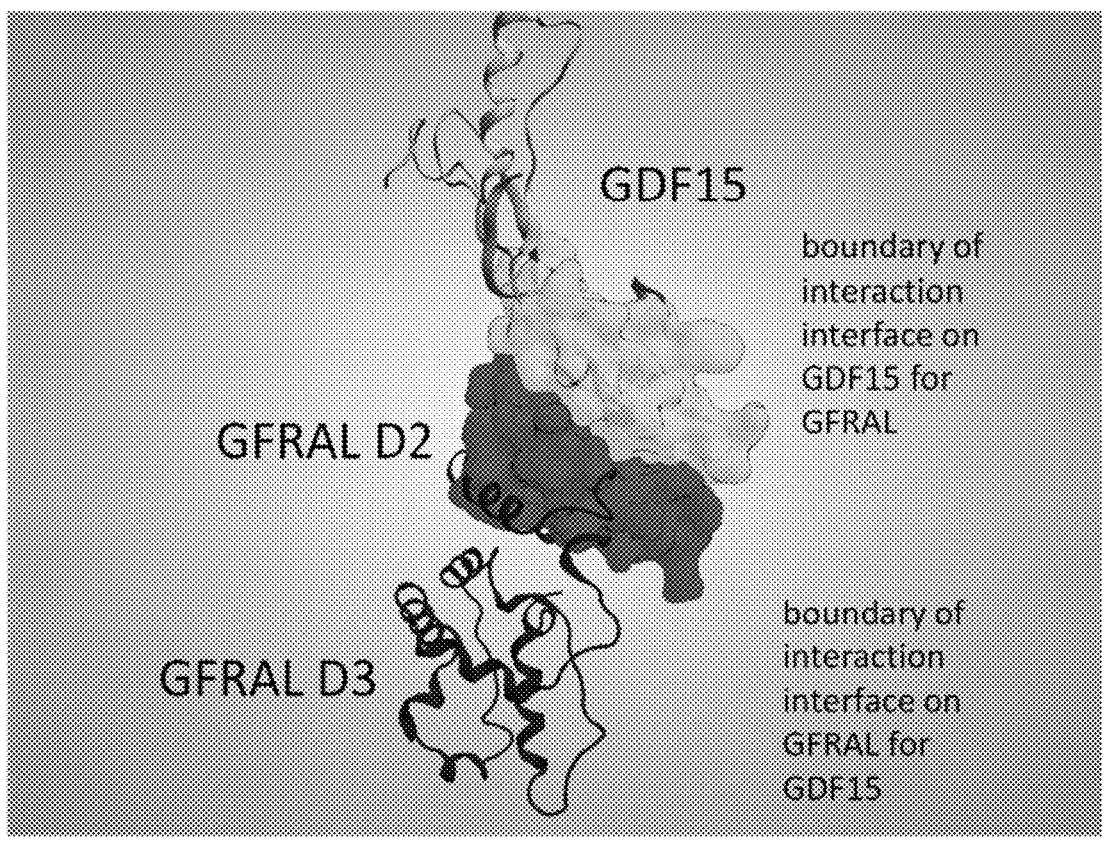

FIGS. 36A-36D illustrate different aspects of a GFRAL/GDF15 interface and the core and boundary amino acid residues of a GFRAL protein and a GDF15 protein involved in forming a GFRAL/GDF15 interface. The GFRAL protein and the GDF15 protein are depicted as ribbon diagrams with residues in the GFRAL/GDF15 interface shown in a space-filled surface representation. FIGS. 36A-36C show core interaction interface amino acids of the GFRAL protein and the GDF15 protein. FIG. 36D shows boundary interaction interface amino acids.

The amino acid sequence of a full-length precursor human GFRAL protein is shown below:

```
GFRAL sequences
                                    SEQ ID NO: 1797
        10         20         30         40
MIVFIFLAMG LSLENEYTSQ TNNCTYLREQ CLRDANGCKH 50         60         70         80
AWRVMEDACN DSDPGDPCKM RNSSYCNLSI QYLVESNFQF 90        100        110        120
KECLCTDDFY CTVNKLLGKK CINKSDNVKE DKFKWNLTTR 130        140        150        160
SHHGFKGMWS CLEVAEACVG DVVCNAQLAS YLKACSANGN 170        180        190        200
PCDLKQCQAA IRFFYQNIPF NIAQMLAFCD CAQSDIPCQQ 210        220        230        240
SKEALHSKTC AVNMVPPPTC LSVIRSCQND ELCPRHYRTF 250        260        270        280
QSKCWQRVTR KCHEDENCIS TLSKQDLTCS GSDDCKAAYI 290        300        310        320
DILGTVLQVQ CTCRTITQSE ESLCKIFQHM LHRKSCFNYP 330        340        350        360
TLSNVKGMAL YTRKHANKIT LTGFHSPFNG EVIYAAMCMT 370        380        390
VTCGILLLVM VKLRTSRISS KARDPSSIQI PGEL
```

GFRAL amino acids at the interface of the GFRAL/GDF15 complex are shown in Table 38.

TABLE 38

| GFRAL Residues Binding GDF15* | |
|---|---|
| Core interaction interface amino acids | Boundary interaction interface amino acids |
| GLY140 | SER156 |
| LEU148 | GLN147 |
| ALA149 | LEU148 |
| ALA146 | ALA149 |
| VAL142 | SER150 |
| ASN145 | TYR151 |
| VAL139 | LEU152 |
| ALA135 | LYS153 |
| GLU136 | ALA154 |
| LEU152 | CYS155 |
| LEU132 | PHE174 |
| SER201 | TYR175 |
| ALA204 | GLU136 |
| LEU205 | ALA137 |
| LYS153 | CYS138 |
| ILE196 | VAL139 |
| PRO197 | GLY140 |
| GLN200 | ASP141 |
|  | VAL142 |
|  | VAL143 |
|  | CYS144 |
|  | ASN145 |
|  | ALA146 |
|  | LEU186 |
|  | CYS189 |
|  | CYS191 |
|  | ALA192 |
|  | GLN193 |
|  | SER194 |
|  | ASP195 |
|  | ILE196 |
|  | PRO197 |
|  | CYS198 |
|  | GLN199 |
|  | GLN200 |
|  | SER201 |
|  | LYS202 |
|  | GLU203 |
|  | ALA204 |
|  | LEU205 |
|  | HIS206 |
|  | SER207 |
|  | SER130 |
|  | CYS131 |
|  | LEU132 |
|  | GLU133 |
|  | VAL134 |
|  | ALA135 |

*GFRAL amino acid numbering according to SEQ ID NO: 1797

The amino acid sequence of mature human GDF15 is shown below:

```
                                        (SEQ ID NO: 1811)
ARNGDHCPLG PGRCCRLHTV RASLEDLGWA DWVLSPREVQ

VTMCIGACPS QFRAANMHAQ IKTSLHRLKP DTVPAPCCVP

ASYNPMVLIQ KTDTGVSLQT YDDLLAKDCH CI
```

GDF15 residues at the interface of the GFRAL/GDF15 complex are shown in Table 39.

TABLE 39

| Residues on GDF15 that bind to GFRAL* | |
|---|---|
| Core interaction interface amino acids | Boundary interaction interface amino acids |
| SER35 | SER35 |
| LEU34 | VAL33 |
| THR94 | LEU34 |
| GLY95 | ASP93 |
| GLN40 | THR94 |
| VAL96 | GLY95 |
| LEU98 | VAL39 |
| PRO36 | GLN40 |
| VAL87 | ARG37 |
| LEU88 | GLU38 |
| ILE89 | VAL96 |
| ASP102 | SER97 |
| THR100 | LEU98 |
| PRO85 | PRO36 |
| MET86 | VAL87 |
|  | LEU88 |
|  | ILE89 |
|  | VAL41 |
|  | GLN90 |
|  | LYS91 |
|  | THR92 |
|  | THR42 |
|  | LEU104 |
|  | LEU105 |
|  | TYR101 |
|  | ASP102 |
|  | ASP103 |
|  | GLN99 |
|  | THR100 |
|  | LEU24 |
|  | TRP32 |
|  | TRP29 |
|  | ARG21 |
|  | THR19 |
|  | TYR83 |
|  | ASN84 |
|  | PRO85 |
|  | MET86 |
|  | VAL20 |

*GDF15 amino acid numbering according to SEQ ID NO: 1811

D: Model of GFRAL/RET/GDF15 Complex

The RET/GFRα1/GDNF ternary complex described by Goodman et al. (2014) CELL REPORTS 8, 1894-1904 (PDB 4UX8) was used as a template to build a model of the complex of GFRAL/GDF15/RET (from GFRAL/GDF15 structure, see, e.g., Examples 11-13). The RET/GFRα1/GDNF template resulted from an electron microscopy reconstruction of a reconstituted mammalian RET(ECD)-GDNF-GFRα1 ternary complex (Goodman et al., supra).

To compare the structural similarity of the GFRAL/GDF15 crystal structure from Example 12 and the structure of GFRα1/GDNF in the RET/GFRα1/GDNF template, the GFRAL structure in GFRAL/GDF15 crystal was superposed with GFRα1 in GFRα1/GDNF/RET model (PDB 4UX8) using MOE from CCG. The high quality of the superposition, and therefore the structural similarity of the GFRAL/GFRα1 and GFRAL/GDF15 complexes was demonstrated by an RMSD of GFRAL/GFRα1 backbone residues of 2.21 Å. This ternary complex model, including the GFRAL/GDF15 structure and the RET structure, was used to map the interactions between GFRAL and RET.

Figure 37A:
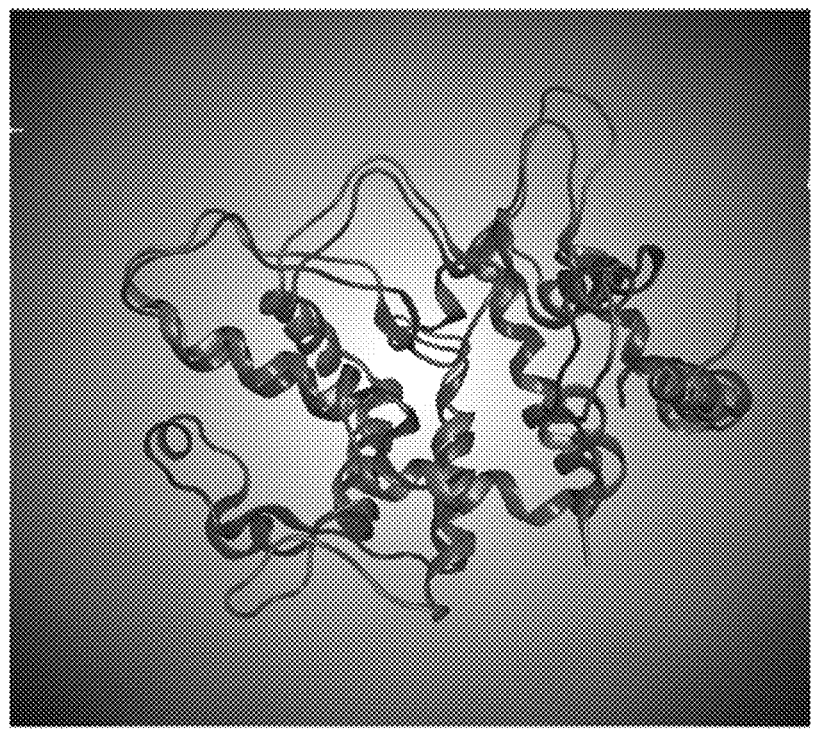
FIGS. 37A-37B show different aspects of a superposition of a GFRAL protein and GFRα1 depicted as ribbon diagrams.
Figure 37B:
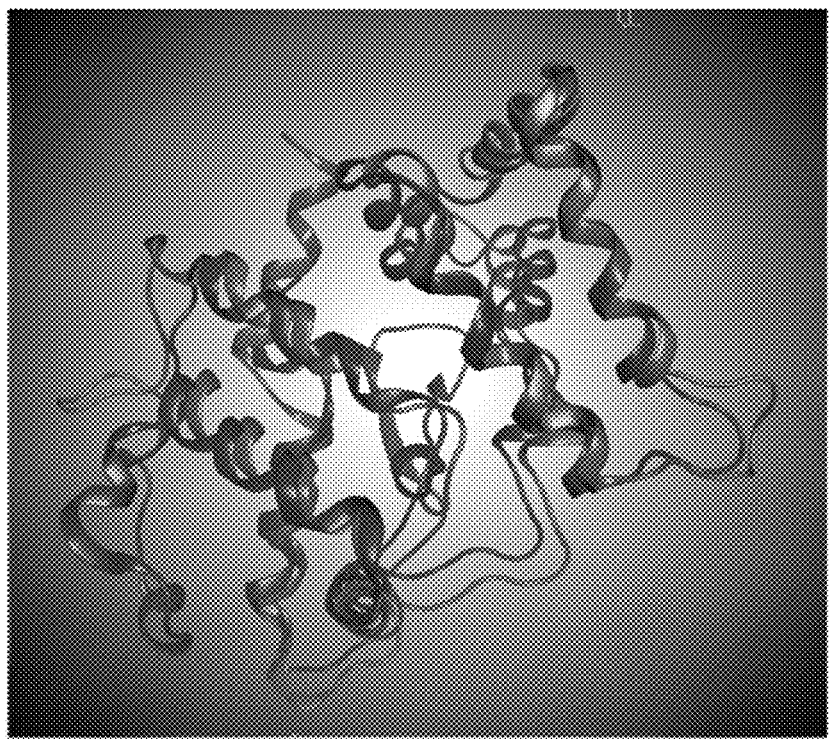

FIGS. 37A-37B illustrate exemplary aspects of the superposition of GFRAL and GFRα1 in 4XU8. RMSD of backbone residues was 2.21 Å.

Figure 38A:
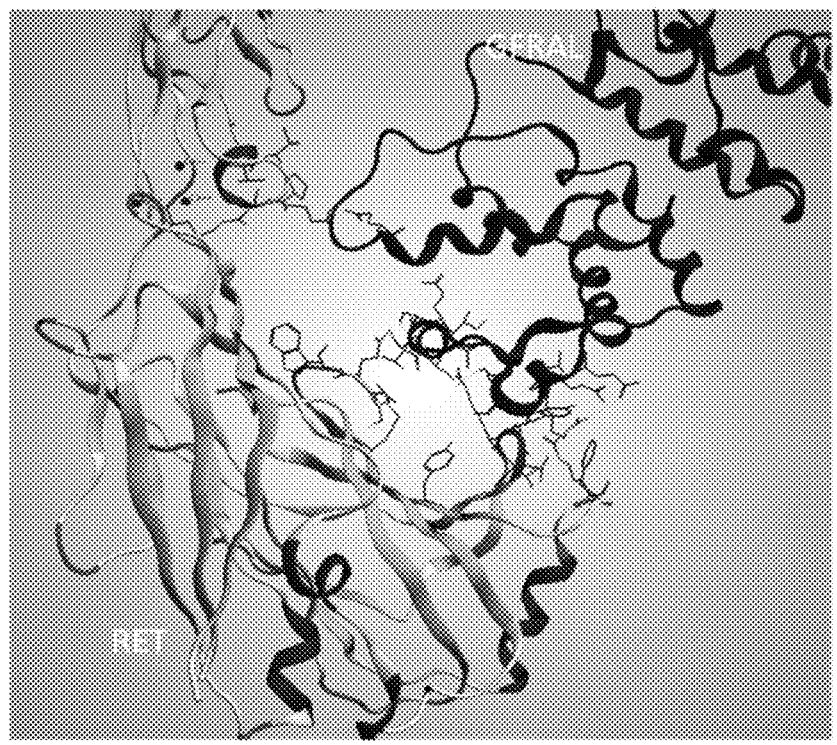
FIGS. 38A-38D illustrate different aspects of the interaction of a GFRAL protein with a RET protein in a RET/GFRAL/GDF15 model.
Figure 38B:
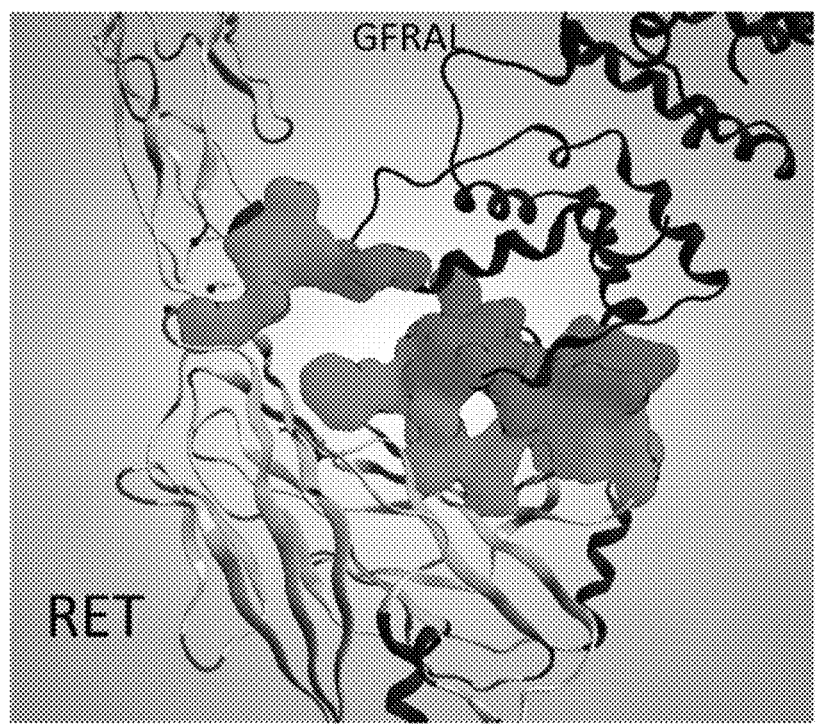
Figure 38C:
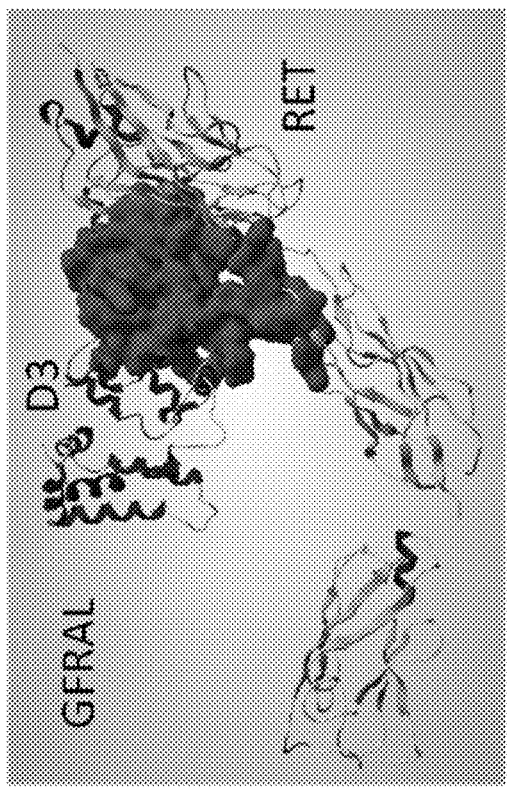
Figure 38D:
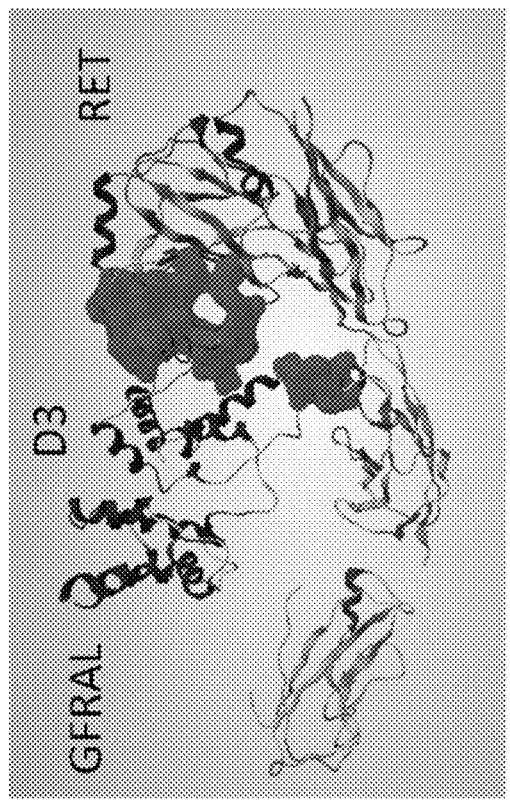

FIGS. 38A-38D illustrate exemplary aspects of the interaction of a GFRAL protein with a RET protein in a RET/GFRAL/GDF15 model. In FIG. 38A, interacting GFRAL and GDF15 residues at the GFRAL/GDF15 interface as modeled are represented by stick models. In FIG. 38B, the RET-interacting residues on GFRAL are depicted in a space filled surface model. In FIG. 38C, the space filled surface model of the core interaction residues are highlighted on GFRAL and RET. In FIG. 38D, the space filled surface model of the boundary interaction residues are highlighted on GFRAL and RET.

Figure 39A:
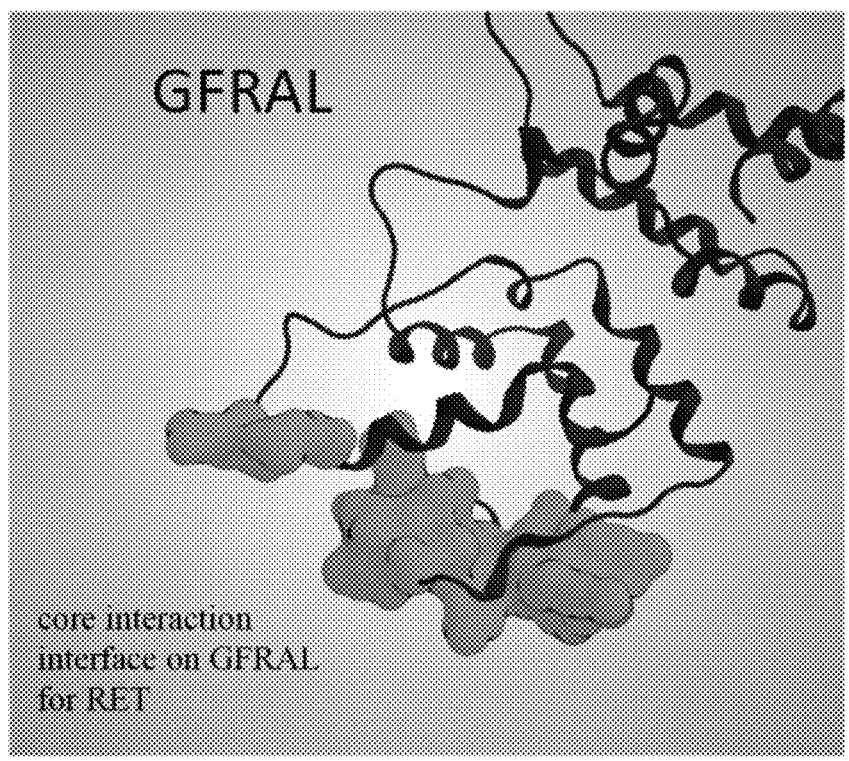
FIGS. 39A-39B illustrate amino acid residues on the RET protein interface of a GFRAL protein.
Figure 39B:
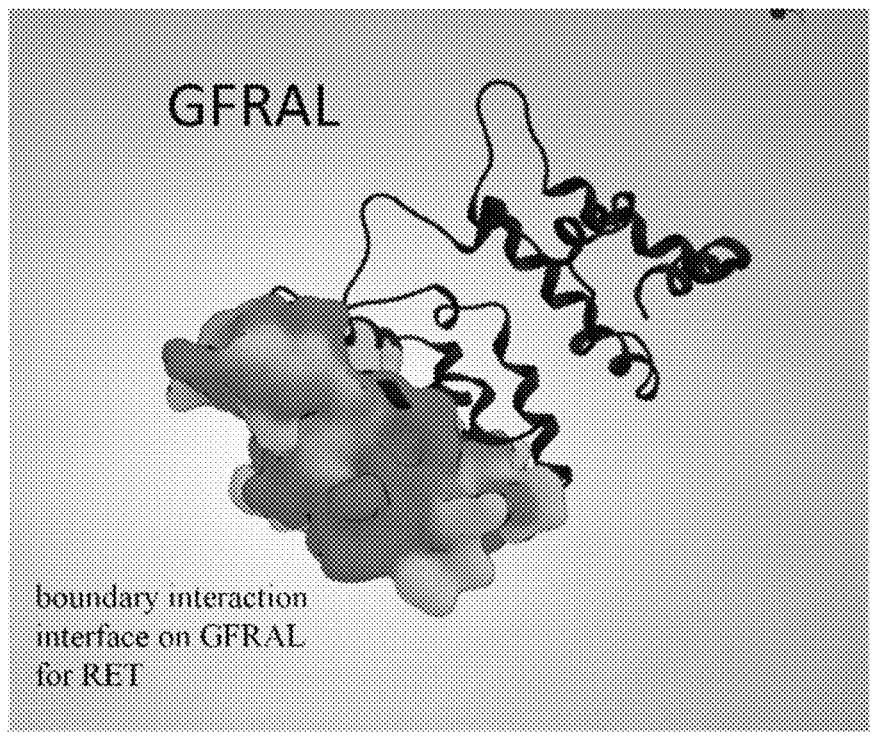

FIGS. 39A-39B illustrate the core and boundary amino acid residues on a GFRAL protein identified in space filled surface models at the modeled RET interface. In FIG. 39A, core residues on GFRAL as modeled are shown in a darker grey in a space-filled surface model. In FIG. 39B, boundary residues on GFRAL as modeled are shown in a lighter grey in a space filled surface model.

Based on this modeling, a number of GFRAL residues were identified for interaction with RET residues, as shown in Table 40A. Additionally, a number of RET residues were identified for interaction with GFRAL residues, as shown in Table 40B.

TABLE 40A

| Residues on GFRAL that bind to RET in RET/GFRAL/GDF15 Model | |
|---|---|
| Core interaction interface amino acids | Boundary interaction interface amino acids |
| GLN246 | ILE224 |
| ARG247 | ARG225 |
| ARG250 | GLN241 |
| LYS251 | SER242 |
| CYS252 | LYS243 |
| ASP255 | CYS244 |
| GLU256 | TRP245 |
| ASN257 | GLN246 |
| CYS258 | ARG247 |
| ILE259 | VAL248 |
| SER260 | THR249 |
| THR261 | ARG250 |
| LEU262 | LYS251 |
| THR297 | CYS252 |
| GLN298 | HIS253 |
| SER299 | GLU254 |
|  | ASP255 |
|  | GLU256 |
|  | ASN257 |
|  | CYS258 |
|  | ILE259 |
|  | SER260 |
|  | THR261 |
|  | LEU262 |
|  | SER263 |
|  | LYS264 |
|  | GLN265 |
|  | ASP266 |
|  | LEU267 |
|  | THR268 |
|  | THR295 |
|  | ILE296 |
|  | THR297 |
|  | GLN298 |
|  | SER299 |

TABLE 40A-continued

Residues on GFRAL that bind to RET in RET/GFRAL/GDF15 Model

| Core interaction interface amino acids | Boundary interaction interface amino acids |
|---|---|
| | GLU300 |
| | GLU301 |
| | SER302 |
| | LEU303 |
| | ILE306 |
| | PHE307 |
| | MET310 |

TABLE 40B

Residues on RET that bind to GFRAL in RET/GFRAL/GDF15 Model

| Core interaction interface amino acids | Boundary interaction interface amino acids |
|---|---|
| GLY74 | ASP34 |
| THR75 | ALA35 |
| TYR76 | TYR36 |
| ARG77 | HIS71 |
| THR78 | TYR73 |
| ASN113 | LEU72 |
| ARG114 | GLY74 |
| PHE116 | TYR76 |
| TYR122 | THR75 |
| GLN138 | ARG77 |
| ARG144 | THR78 |
| PRO305 | ARG79 |
| ALA306 | LEU80 |
| LEU310 | LEU109 |
| | SER110 |
| | VAL111 |
| | ARG112 |
| | ASN113 |
| | GLY115 |
| | ARG114 |
| | PHE116 |
| | PRO117 |
| | LEU118 |
| | THR120 |
| | VAL121 |
| | TYR122 |
| | LEU123 |
| | LYS124 |
| | CYS137 |
| | GLN138 |
| | TRP139 |
| | PRO140 |
| | GLY141 |
| | CYS142 |
| | ALA143 |
| | ARG144 |
| | VAL145 |
| | TYR146 |
| | PHE147 |
| | ARG231 |
| | ASP264 |
| | ASP300 |
| | VAL303 |
| | VAL304 |
| | PRO305 |
| | ALA306 |
| | SER307 |
| | GLY308 |
| | GLU309 |
| | LEU310 |
| | ARG312 |
| | VAL311 |
| | ASN336 |

Example 12: Crystal Structures of GFRAL/Antibody Complexes

A1: Complex Formation and Crystallization of GFRAL/3P10/25M22 Fab Complex

A complex of a GFRAL protein, a 3P10 Fab and a 25M22 Fab (GFRAL/3P10/25M22 Fab complex) was formed by mixing GFRAL(W115-E351) with Fabs of 3P10 and 25M22 in a 1:1.2:1.2 molar ratio of GFRAL:3P10 Fab:25M22 Fab. The complex was purified from excess Fab molecules on a size exclusion chromatography column. The GFRAL/3P10/25M22 Fab complex was concentrated and crystallized as follows.

A volume of 1.5 mL of 3P10 Fab::GFRAL::25M22 Fab complex sample was concentrated by centrifugation to about 6.6 mg/mL using 10,000 MWCO Centricon® concentrator. The concentrated sample was immediately subjected to crystallization screening using 1 µL protein plus 1 µL reservoir per experiment. A first set of 96 conditions were set up that covered a factorial-based formulation sampling for the reservoir content. The crystallization setups were incubated at room temperature. Hampton Index and PegRx crystallization screens were used in the initial rounds of crystallization. The Hampton Index screen did not yield any potential hits, whereas the PegRx screen yielded crystals under the following three crystallization conditions B11, D11, and H8:

B11: 0.1 M MES pH 6.0, 20% PEGMME 2000
D11: 0.1 M Imidazole pH 7.0, 12%, PEG 20,000
H8: 0.1 M TRIS pH 8.0, 16% PEG 10,000, 0.2 M Amonium Acetate.

Figure 40:
FIG. 40 illustrates exemplary crystals of a complex having a GFRAL protein, a 3P10 Fab and a 25M22 Fab produced under crystallization conditions B11, D11, and H8.

Exemplary crystals of GFRAL/3P10/25M22 Fab complexes obtained under crystallization conditions B11, D11, and H8 are shown in FIG. 40.

To further optimize crystals for X-ray diffraction, GFRAL/3P10/25M22 complex was concentrated to 5.0 mg/mL and set up for crystallization and additional optimization, which led to improved crystals. Some improved crystals had a trapezium form. Some of the improved crystals were harvested, treated with a compatible cryoprotectant, and flash-frozen in liquid nitrogen. Identification and use of a compatible cryoprotectant was important to maintain sample crystallinity and to collect a high quality X-ray diffraction data set. Improved crystals obtained from a crystallization condition including 0.1 M Imidazole pH 7.0, 12% PEG 20,000 (D11) were treated with 35% ethylene glycol. Multiple crystals were flash-frozen in liquid nitrogen and X-ray diffraction data was collected at a synchrotron (ALS). One crystal diffracted to about 2.9 Å resolution. A full X-ray diffraction dataset was collected with this crystal.

The GFRAL/3P10/25M22 Fab complex crystal structure was determined. The position of the GFRAL component was clearly identified by molecular replacement based on the higher α-helix content in GRAL compared to 3P10 and 25M22 Fabs. In the exemplary crystal described here, one GFRAL and two Fab components (one 3P10 Fab and one 25M22 Fab) formed a ternary complex in the asymmetric crystal unit.

Molecular replacement was used to identify Fabs in the GFRAL/3P10/25M22 Fab complex. PDB 1F8T, was the closest GFRAL homolog available for molecular replacement analysis (~54% identity and ~79% similarity to GFRAL). The structure solution clearly showed all Fab and GFRAL amino acid positions. The 1F8T GFRAL homolog structure was used as a stepping stone to solve the Fab and GFRAL components of the GFRAL/3P10/25M22 terniary complex crystal structure. In this structure, the stoichiometry in the was determined to be 1:1:1 3P10 Fab::GFRAL::25M22 Fab.

A2: Complex Formation and Crystallization of GFRAL/8D8/5F12 Fab Complex

A complex of a GFRAL protein, an 8D8 Fab and a 5F12 Fab (GFRAL/8D8/5F12 Fab complex) was formed by mixing GFRAL(W115-E351) with Fabs of 8D8 and 5F12 in a 1:1.2:1.2 molar ratio of GFRAL:8D8 Fab:5F12 Fab. The complex was purified from excess Fab molecules on a size exclusion chromatography column. The GFRAL/8D8/5F12 Fab complex was concentrated and crystallized as follows.

GFRAL/5F12/8D8 Fab complex was concentrated by centrifugation using 10,000 MWCO Centricon® concentrator. The concentrated sample was immediately subjected to crystallization screening using 1 μL protein plus 1 μL reservoir per experiment. A set of 96 conditions were initially set up that cover a factorial-based formulation sampling for the reservoir content. The crystallization setups were incubated at room temperature. Positive leads from initial screens were further optimized to yield high quality crystals that were amenable to diffraction analysis.

A volume of 1.5 mL of 5F12 Fab::GFRAL::8D8 Fab complex sample is concentrated by centrifugation to about 7.8 mg/mL using 10000 MWCO Centricon concentrator. Immediately upon completion, this sample is subjected to crystallization screening using 1 μL protein plus 1 μL reservoir per experiment. A set of 96 conditions are initially setup that cover a factorial-based formulation sampling for the reservoir content. These setups are incubated at room temperature. Initially, Hampton Index and PegRx crystallization screens were used for crystallization, Index and PegRx gave crystals in the following three crystallization conditions C6, E11, and C2:

C6: 0.1 M Bis-Tris pH 6.5, 14% PEG 3350
E11: 1.7 M AmSO4, 0.1 M Bis-Tris pH 6.5, 3% PEG MME 550
C2: 0.1 M Imidazole pH 7.0, 20% Jeffamine 2001.

Figure 41:
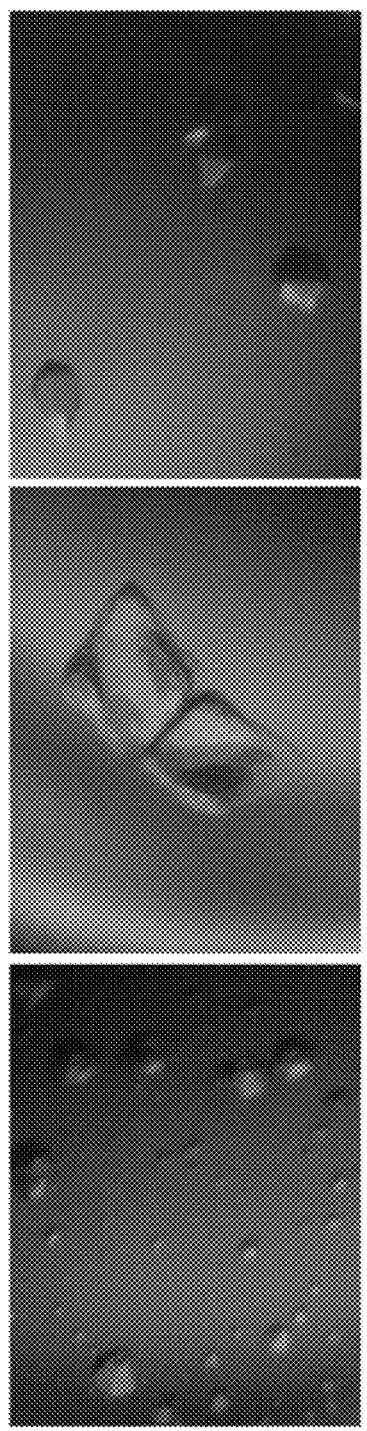
FIG. 41 illustrates exemplary crystals of a complex having a GFRAL protein, a 8D8 Fab and a 5F12 Fab produced under crystallization conditions C6, E11, and C2.

Preliminary crystals were obtained as shown in FIG. 41.

Optimization of PegRx C6 and C2 crystallizing conditions was conducted by micro seeding technique, which lead to suitable diffraction mono-crystals. These suitable diffraction mono-crystals have a hexagonal bipyramid form obtained in 10% Ethylene glycol with 0.1 M Imidazole pH 7.0, 20% Jeffamine 2001 pH 7.0. Some of these crystals were harvested; treated with a compatible cryoprotectant; and flash-frozen in liquid nitrogen. Use of a compatible cryoprotectant is important to maintain the sample crystallinity, which results in a workable data set. The crystals were treated 20% MPD obtained from 0.1 M Imidazole pH 7.0, 20% Jeffamine 2001 pH 7.0.

B1: Data Collection and Structure Determination of GFRAL/3P10/25M22 Fab Complex

X-Ray diffraction data was collected for twenty crystals of the GFRAL/3P10/25M22 Fab complex at a synchrotron (ALS). The first ten crystals yielded one complete data set with a resolution of 3.17 Å. Ten additional crystals that were further optimized diffracted up 2.9 Å, and this data set was used for structure determination and refinement. The X-ray diffraction data was indexed using DENZO and subsequently integrated and scaled with SCALEPACK from the program suite HKL2000. See Otwinowski Z. and Minor W. "Processing of X-ray Diffraction Data Collected in Oscillation Mode," METHODS IN ENZYMOLOGY, Volume 276: Macromolecular Crystallography, part A, p. 307-326, 1997, C. W. Carter, Jr. & R. M. Sweet, Eds., Academic Press (New York). The X-ray diffraction of the selected crystal was identified as having an orthorhombic Bravais lattice symmetry. The space group was determined to be $P2_12_12_1$ based on the systematic absences along (h, 0, 0), (0, k, 0), and (0, 0, l) axes. Analysis of the Matthew's coefficient suggests the crystal's asymmetric unit may accommodate one assembly with approximately 124.4 kDa and a corresponding solvent content of 56%.

X-ray diffraction statistics for exemplary GFRAL/3P10/25M22 Fab complex crystals are shown in Table 41.

TABLE 41

| Data collection statistics | Crystal I |
| --- | --- |
| Wavelength | 0.9774 Å |
| Space group | $P2_12_12_1$ |
| Unit cell (Å) | a = 52.500 |
|  | b = 116.045 |
|  | c = 227.048 |
| Resolution (Å)† | 50-2.91 |
|  | (3.01-2.91) |
| Number of measurements | 227,808 |
| Number of unique reflections | 31,548 |
| $R_{sym}$ (%)† | 0.11 (0.86) |
| Completeness (%)† | 100 (100) |
| I/σ † | 17.8 (2.7) |
| Redundancy† | 7.2 (7.2) |
| Molecules in the A.U. | 2 Fabs |
|  | 1 GFRAL |

†The parenthesis is for the highest resolution shell in Å.

Molecular replacement of the GFRAL/3P10/25M22 Fab Complex was performed by using the scaled dataset with the previously solved GFRAL (see Example 12, part C) and the 79% homologous GFRAL structure of 1F8T as starting models within the program PHASER. Data extending from 40-3.5 Å resolution gave one GFRAL and one Fab. Molrep yielded one more Fab in the structure solution. The solution had a complex of one GFRAL and two Fabs in the asymmetric unit. The solution was refined using REFMAC. COOT was used for model building. The refinement density clearly indicates missing loops in Fabs and GFRAL. After placement of a few solvent molecules final refinement was completed.

The atomic coordinates from the x-ray diffraction patterns for the GFRAL/3P10/25M22 Fab Complex are found in Table 50.

Exemplary refinement statistics of a GFRAL/3P10/25M22 Fab Complex crystal structure are shown in Table 42.

TABLE 42

| Refinement Statistics | |
| --- | --- |
| Refinement Range (Å) | 47.7-2.9 |
| $R_{cryst}$ (%) | 23.6 |
| $R_{free}$ (%) | 31.0 |
| Molecules 3P10 Fab::GFRAL::25M22 Fab | 1, 1, 1 |
| Bond lengths (Å) | 0.011 |
| Bond angles (°) | 1.651 |
| Average B-factors (Å²) | Overall |
| Main chain atoms (GFRAL) | 66.3 |
| Side chain atoms (GFRAL) | 71.6 |
| Main chain atoms (3P10) Hc:Lc | 92.7; 75.5 |
| Side chain atoms (3P10) Hc:Lc | 89.8; 78.5 |
| Main chain atoms (25M22) Hc:Lc | 85.5; 101.9 |
| Side chain atoms (25M22) Hc:Lc | 83.4; 101.2 |
| Water molecules | 67.1 |
| Ramachandran Plot (%) | Overall |
| Favored | 78.3 |
| Allowed | 20.6 |
| Disallowed | 1.2 |

Figure 42:
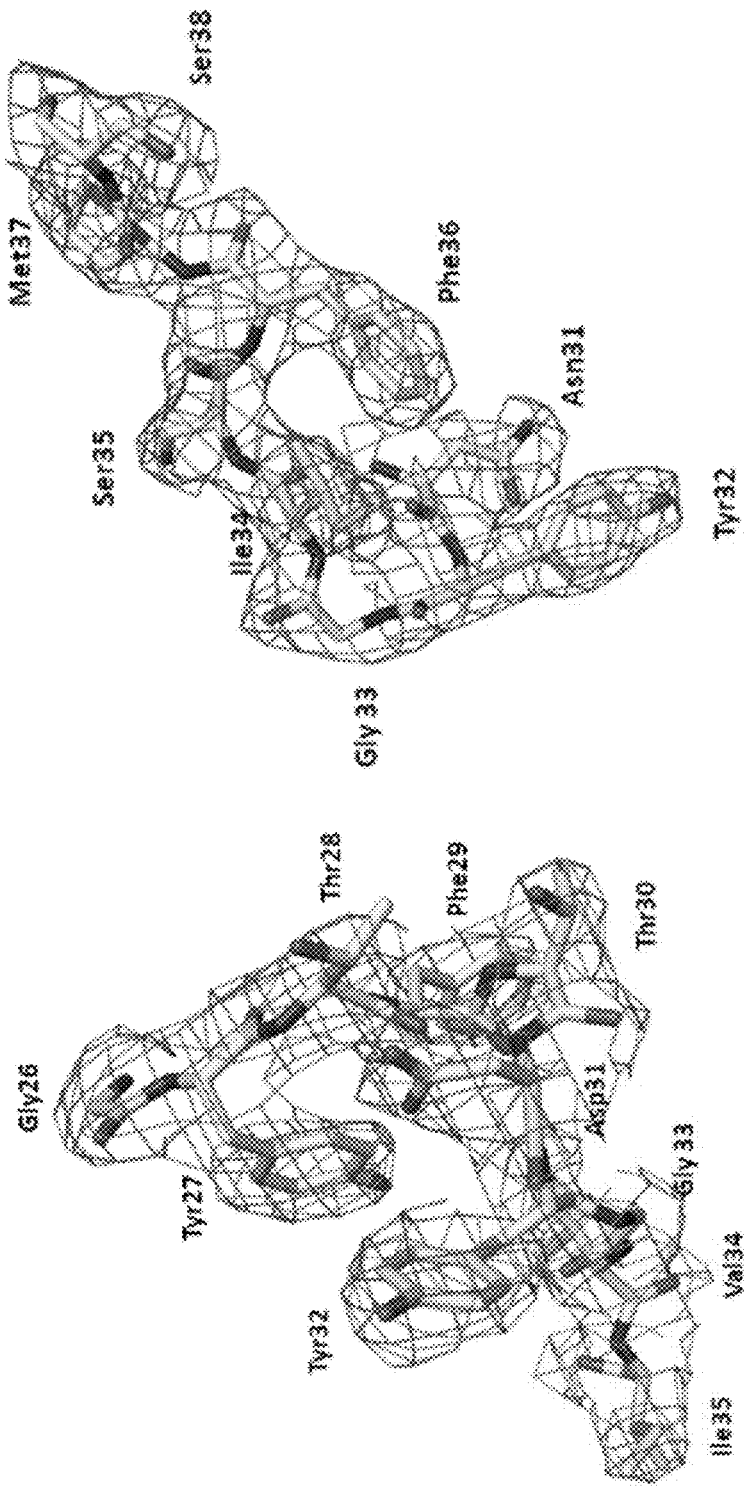
FIG. 42 illustrates exemplary electron density maps of 3P10 Fab and 25M22 Fab CDR regions in the crystal structure of a GFRAL/3P10/25M22 Fab complex.
Figure 42:
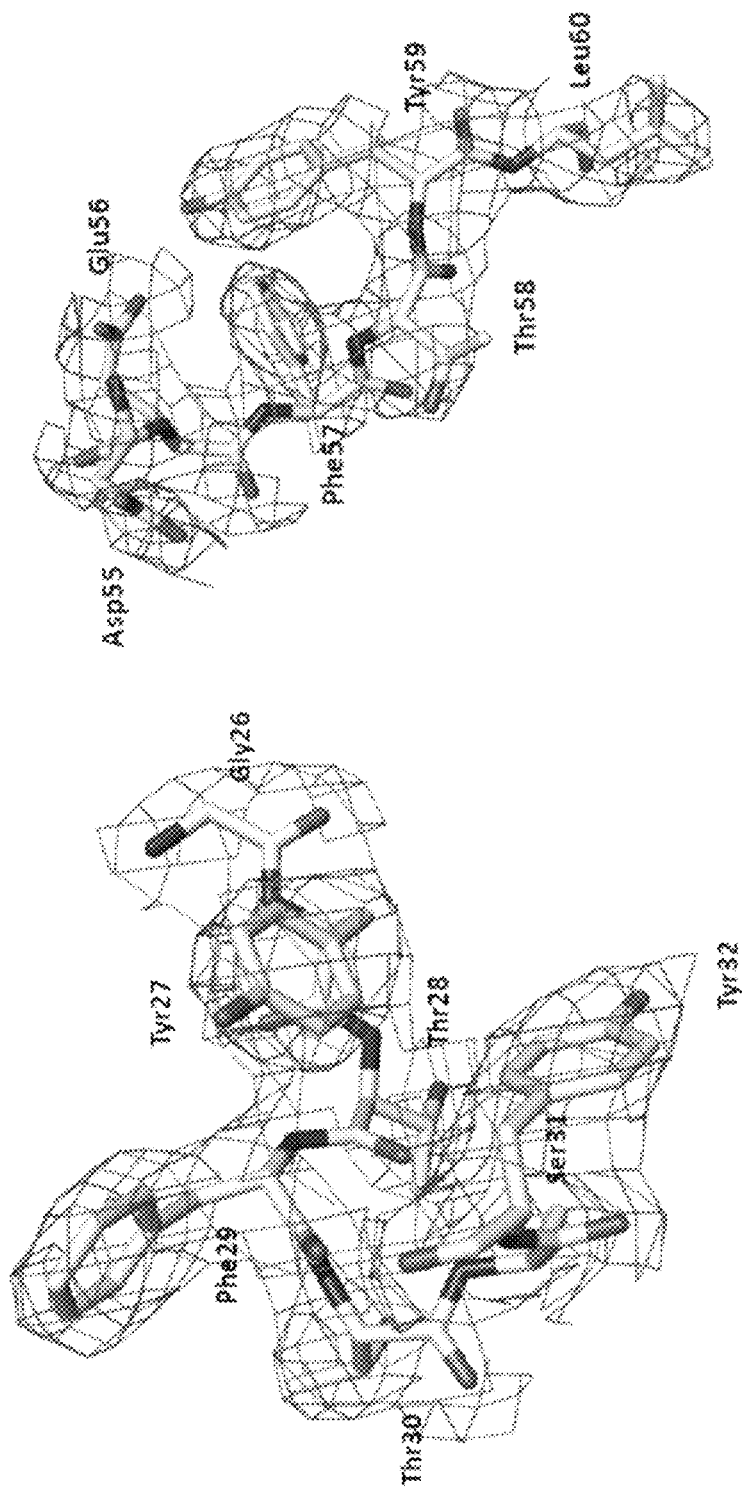

The clear electron densities of CDR regions in each chain of the 3P10 and 25M22 Fab fragments in the GFRAL/3P10/25M22 Fab complex are illustrated in FIG. 42 (electron density 2mFo-DFc weighted, 1.0σ contour level). The 3P10 and 25M22 chains were identified clearly in the electron density, with the exception of region 131-137 in the 3P10 heavy chain (Chain-H), where a few terminal residues were not identified in the electron density.

B2: Data Collection and Structure Determination of GFRAL/8D8/5F12 Fab Complex

The crystals were examined at the synchrotron at APS. Twenty five such crystals were examined for x-ray diffraction. Sixteen crystals were send first time to synchrotron which yielded a diffraction >5 Å and the second round of optimized crystals were diffracted up 3.5 Å, which is used for structure determination and refinement. The X-ray diffraction data were indexed using DENZO and integrated and scaled with SCALEPACK from the program suite HKL2000 (Otwinowski and Minor, 1997). The X-ray diffraction of the selected crystal was identified as having an orthorhombic Bravais lattice symmetry. The space group was determined to be $P6_122$ based on the systematic absences along (h, 0, 0) axes. Analysis of the Matthew's coefficient suggests the crystal's asymmetric unit may accommodate one assembly with approximately 246.6 kDa and a corresponding solvent content of 61%. The structure solution was checked with enantiomeric spacegroup $P6_122$, which gave very poor Rfactor and Rfree during the rigid body and restraint refinement.

X-ray diffraction statistics for the GFRAL/8D8/5F12 complex crystals are shown in Table 43.

TABLE 43

| Data collection statistics | Crystal I |
| --- | --- |
| Wavelength | 0.9787 Å |
| Space group | $P6_522$ |
| Unit cell (Å, °) | a = 133.021 |
|  | b = 133.021 |
|  | c = 564.819 |
|  | γ = 120 |
| Resolution (Å)† | 50-3.55 |
|  | (3.68-3.55) |
| Number of measurements | 524,288 |
| Number of unique reflections | 37,081 |
| $R_{sym}$ (%)† | 0.13 (1.00) |
| Completeness (%)† | 100 (100) |
| I/σ † | 22.0 (3.4) |
| Redundancy† | 14.1 (14.6) |
| Molecules in the A.U. | 4 Fabs |
|  | 2 Receptor |

†The parenthesis is for the highest resolution shell in Å.

Molecular replacement of Fabs/Receptor was performed by using the scaled dataset with the previously solved of fab pdb:3IU4 used for 8D8 (89% homologous) and pdb:4M7K used for 5F12 (84% homologous) were used as a starting models within the program PHASER using the data extending from 40-5.0 Å resolution gave two assembly of one receptor and two Fabs. The solution had two receptors and four Fabs complex in the asymmetric unit. The solution was refined used REFMAC and Coot was used for model building.

The structure solution was checked with enantiomeric spacegroup $P6_122$. The Molrep gave two receptors and four Fabs complex. The Molrep model further submitted to Refmac for refinement end up with very poor $R_{factor}$ and $R_{free}$ during the rigid body and restraint refinement which confirms that the current space group is $P6_522$.

The atomic coordinates from the x-ray diffraction patterns for the GFRAL/8D8/5F12 Fab Complex is found in Table 51.

Exemplary refinement statistics of a GFRAL/8D8/5F12 Fab Complex crystal structure are shown in Table 44.

TABLE 44

| Refinement Statistics | |
| --- | --- |
| Refinement Range (Å) | 49.2-3.55 |
| $R_{cryst}$ (%) | 25.1 |
| $R_{free}$ (%) | 35.8 |
| Molecules 3P10 Fab::GFRAL::25M22 | 2, 2, 2 |
| Bond lengths (Å) | 0.011 |
| Bond angles (°) | 1.63 |

Figure 43:
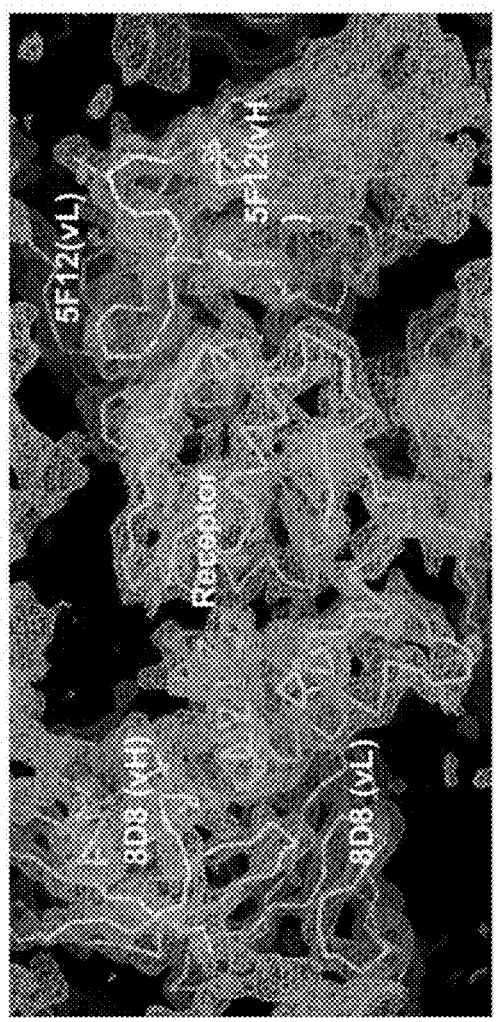
FIG. 43 illustrates an exemplary electron density of a GFRAL/8D8/5F12 Fab complex.

The clear electron density of one GFRAL protein with the 8D8 and 5F12 Fab fragments (two Fab chains) in the GFRAL/8D8/5F12 Fab complex is illustrated in FIG. 43 (electron density 2mFo-DFc weighted, 1.0σ contour level). The refinement density clearly indicates most of the loops in Fabs and receptor molecule. The 5F12 and 8D8 chains were identified clearly in the electron density except for the region between amino acids 139-142 in chain-I (5F12 vH), 132-136 in chain-R (8D8 vH) and 131-136 in chain-U (8D8 vL), as well as a few terminal residues were not identified in the density.

C1: Crystal Structure of GFRAL/3P10/25M22 Fab Complex

The crystal structure of a 3P10 Fab::GFRAL::25M22 Fab complex was determined.

3P10 Fab and 25M22 Fab amino acid sequences are shown below, with VH and VL sequences bolded and CDR regions bolded and underlined.

```
3P10 Fab Hc:
                                          (SEQ ID NO: 1824)
QIQLVQSGPELKKPGETVKISCKASGYTFTDYGVIWVKQAPGKALKWMGWINTYTGE

PTYADDLKGRFAFSLETSASSASLQINNLKNEDTATYFCARRYGPEDIDYWGQGTTL

TVSSASTKGPSVFPLAPSSKSTSGGTAALGCLVKDYFPEPVTVSWNSGALTSGVHTFP

AVLQSSGLYSLSSVVTVPSSSLGTQTYICNVNHKPSNTKVDKKVEPKSCDEVD

3P10 Fab Lc:
                                          (SEQ ID NO: 1825)
DIVLTQSPVSLAVSLGQRATISCRASESVDNYGISFMSWFQQKPGQPPKLLIYAASHQ

GSGVPARFSGSGSGTDFSLNIHPMEEDDSAMYFCLQSKEVPWTFGGGTKLEIKRTVA

APSVFIFPPSDEQLKSGTASVVCLLNNFYPREAKVQWKVDNALQSGNSQESVTEQDS

KDSTYSLSSTLTLSKADYEKHKVYACEVTHQGLSSPVTKSFNRGEC
```

-continued

25M22 Fab Hc:
(SEQ ID NO: 1826)
QVQLQQSGPDLVKPGASVKISCKAS<u>GYTFTSYWVN</u>WMKQRPGKGLEWIG<u>RIYPGD</u>

<u>GDTNYNGKFKG</u>KATLTADKSSSTAYMQLSSLTSEDSAVYFCAR<u>AYLLRLRRTGYYA</u>

<u>MDY</u>WGQGTSVTVSSASTKGPSVFPLAPSSKSTSGGTAALGCLVKDYFPEPVTVSWNS

GALTSGVHTFPAVLQSSGLYSLSSVVTVPSSSLGTQTYICNVNHKPSNTKVDKKVEPK

SCDEVD

25M22 Fab Lc:
(SEQ ID NO: 1827)
DVVLTQTPLSLPVNIGDQASISC<u>KSTKSLLNSDEFTYLD</u>WYLQKPGQSPQLLIF<u>LVSN</u>

<u>RFS</u>GVPDRFSGSGSGTDFTLKISRVEAEDLGVYYC<u>FQSNYLPYT</u>FGGGTKLEIKRTVA

APSVFIFPPSDEQLKSGTASVVCLLNNFYPREAKVQWKVDNALQSGNSQESVTEQDS

KDSTYSLSSTLTLSKADYEKHKVYACEVTHQGLSSPVTKSFNRGEC

Figure 44:
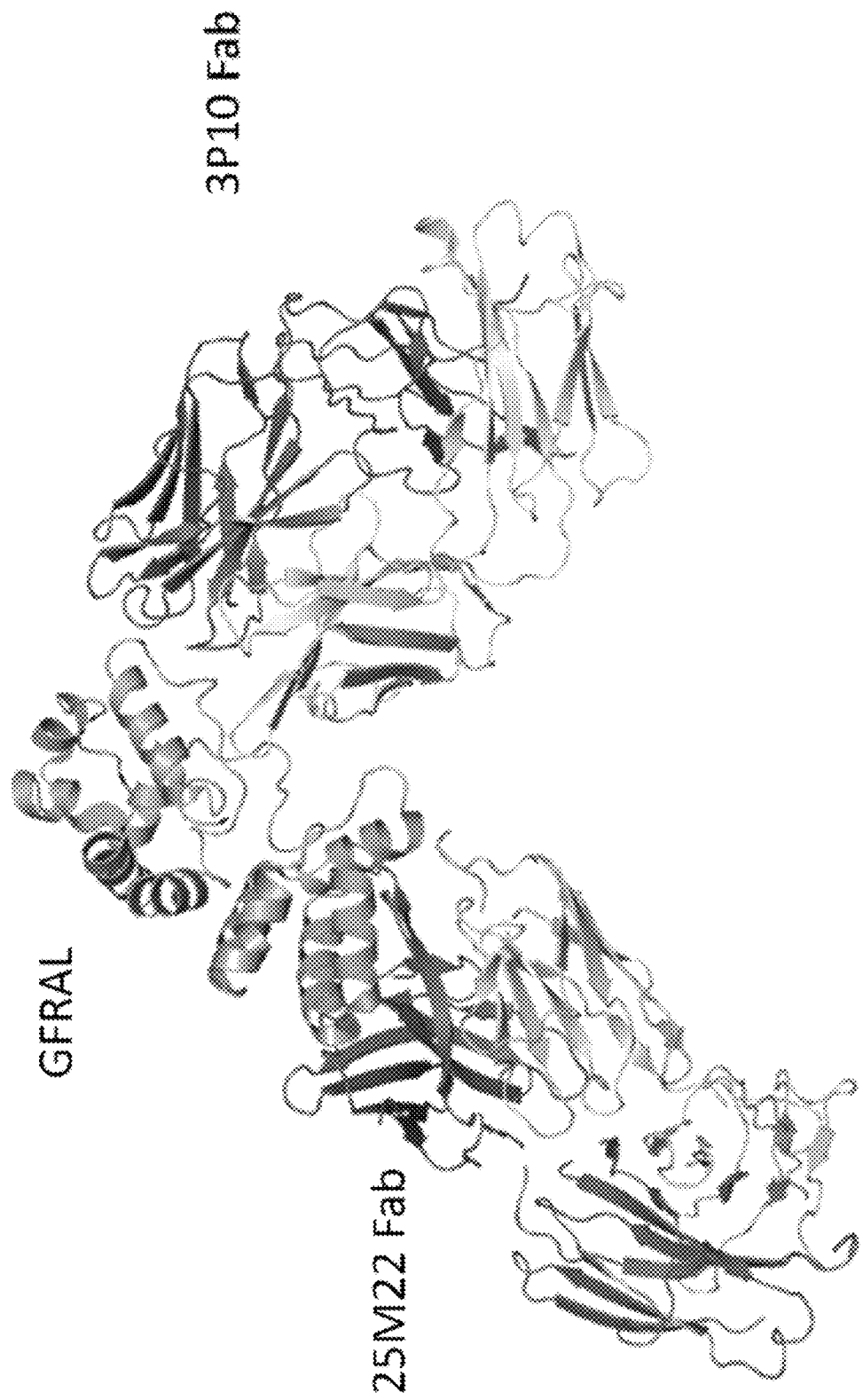
FIG. 44 shows an exemplary ribbon diagram of a GFRAL/3P10/25M22 Fab complex formed in an asymmetric GFRAL/3P10/25M22 Fab complex crystal unit.

FIG. 44 illustrates an aspect of a 3P10 Fab::GFRAL::25M22 Fab complex by a ribbon diagram. The Fab fragments interact with an asymmetric unit of GFRAL in the 3P10 Fab::GFRAL::25M22 Fab complex crystal. The crystal structure also showed that GFRAL epitope residues 290-312 were presented to the 3P10 antibody and GFRAL N-terminal epitope residues 130-157 were presented to the 25M22 antibody heavy chain CDR regions.

Figure 45:
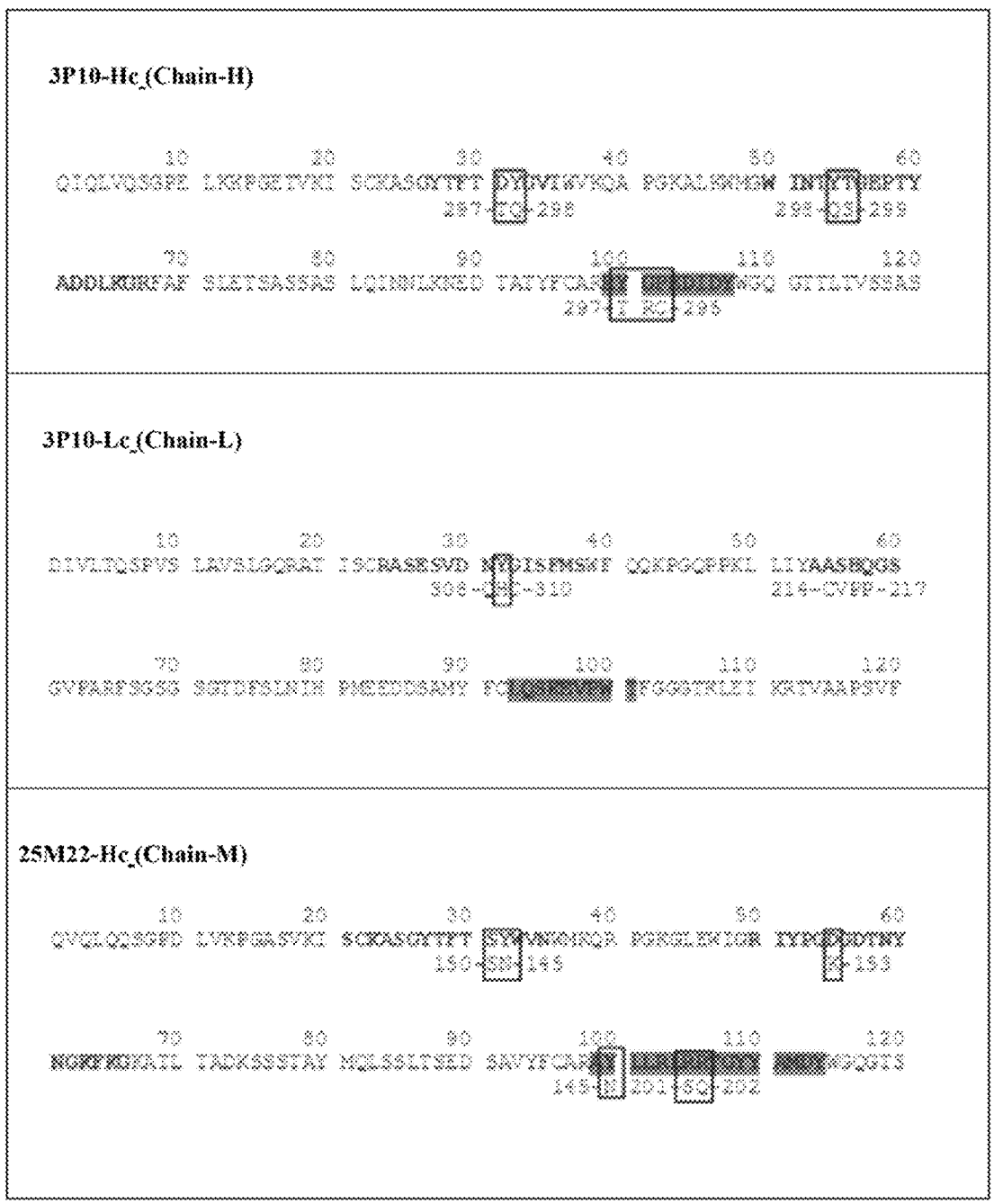
FIG. 45 shows alignments of 3P10 Fab and 25M22 Fab CDR sequences (top lines) with GFRAL amino acid residues (bottom lines) that are involved in 3P10 Fab and 25M22 Fab binding. Residues involved in the GFRAL-Fab interaction are boxed. For the 3P10 Fab, amino acid residues Q1 to S120 of SEQ ID NO: 1824 are shown for the Hc and amino acid residues D1 to F120 of SEQ ID NO: 1825 are shown for the Lc. For the 25M22 Fab, amino acid residues Q1 to S120 of SEQ ID NO: 1826 are shown for the Hc.

FIG. 45 illustrates CDR regions of 3P10 and 25M22 Fabs with interacting GFRAL and Fab residues highlighted in boxes.

Figure 46:
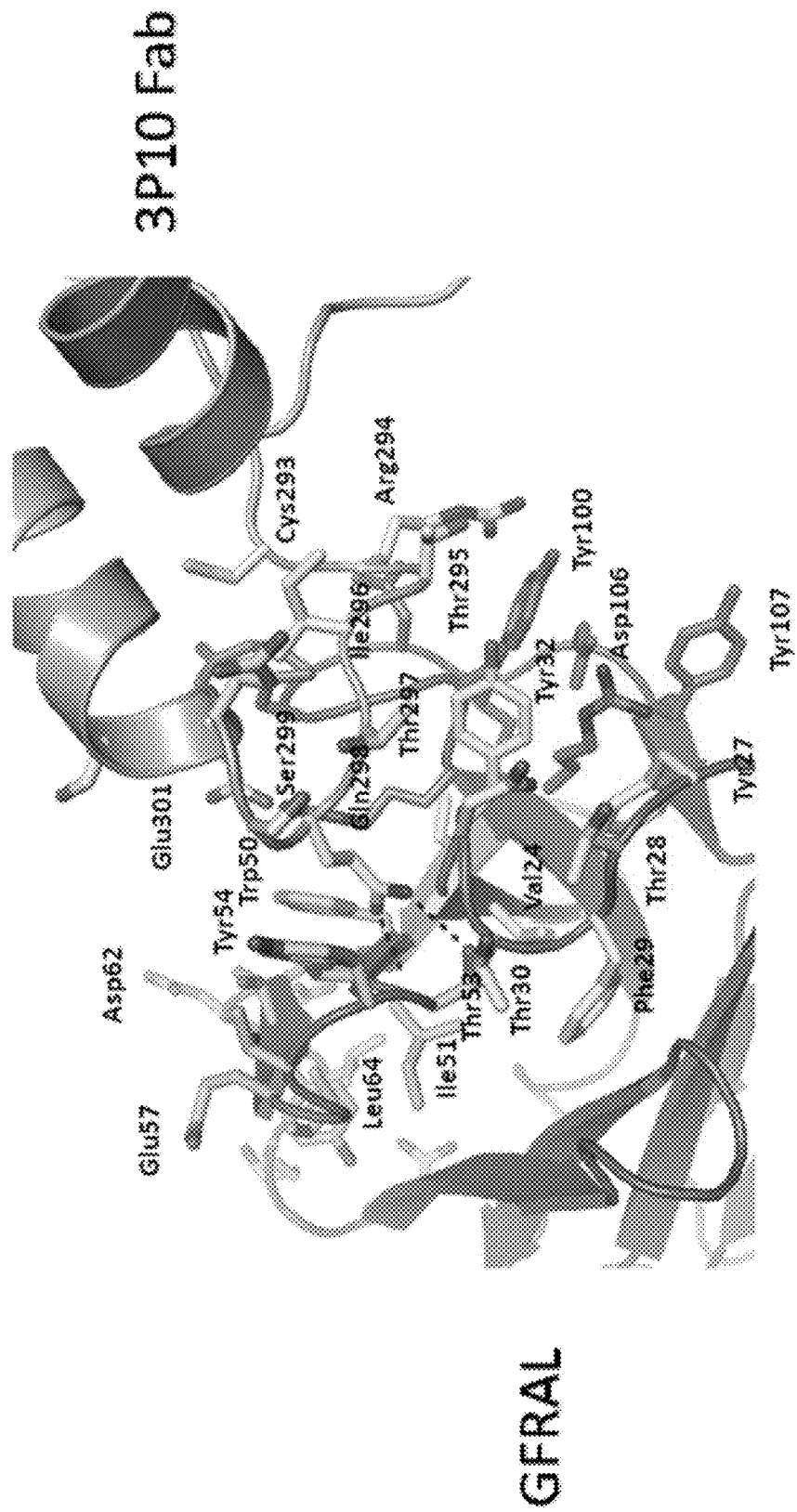
FIG. 46 shows a ribbon diagram illustrating the interaction of a GFRAL 3P10 Fab epitope and a 3P10 Fab heavy chain CDR region.
Figure 47:
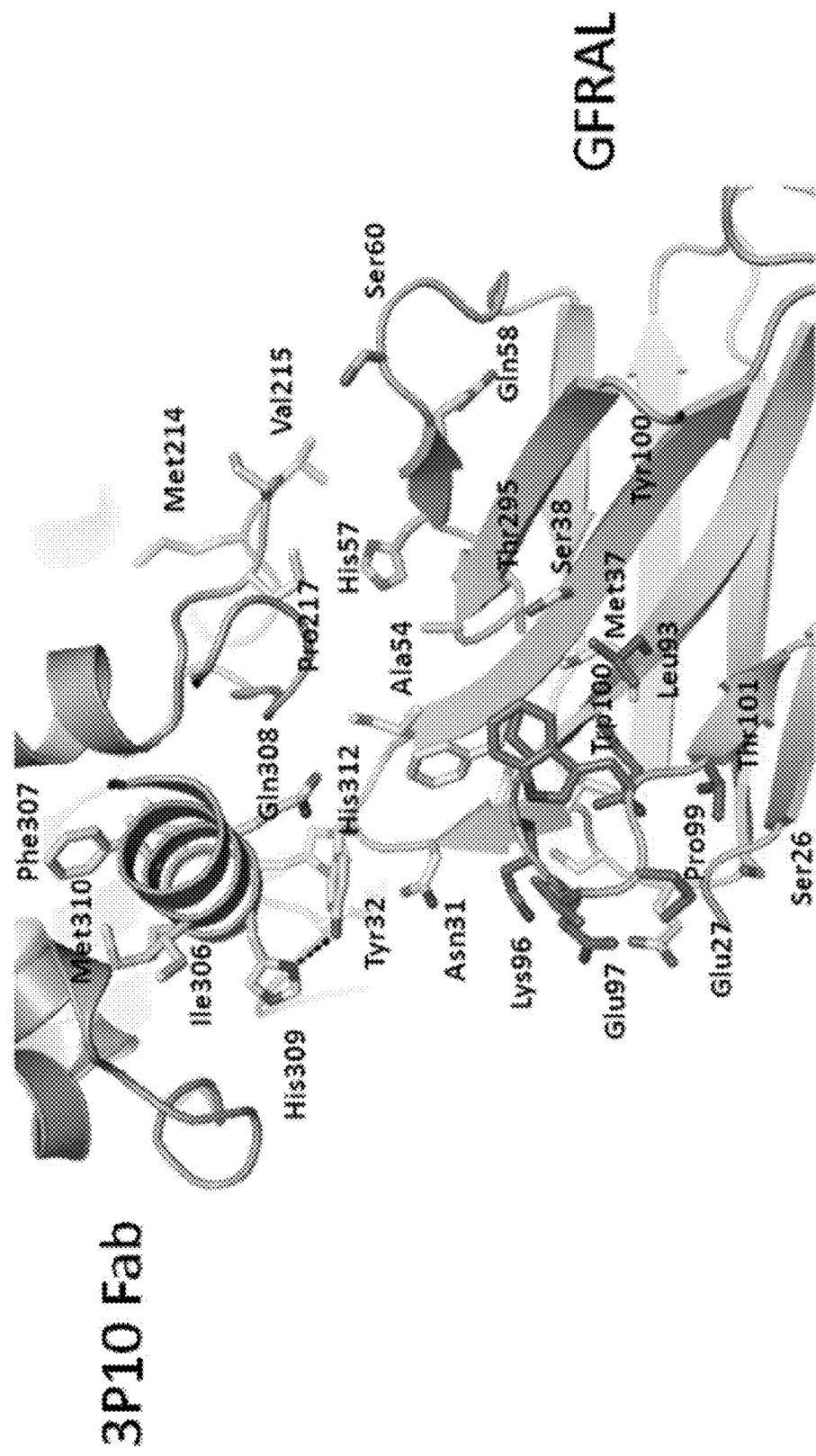
FIG. 47 shows a ribbon diagram illustrating the interaction of a GFRAL 3P10 Fab epitope and a 3P10 light chain CDR region.
Figure 48:
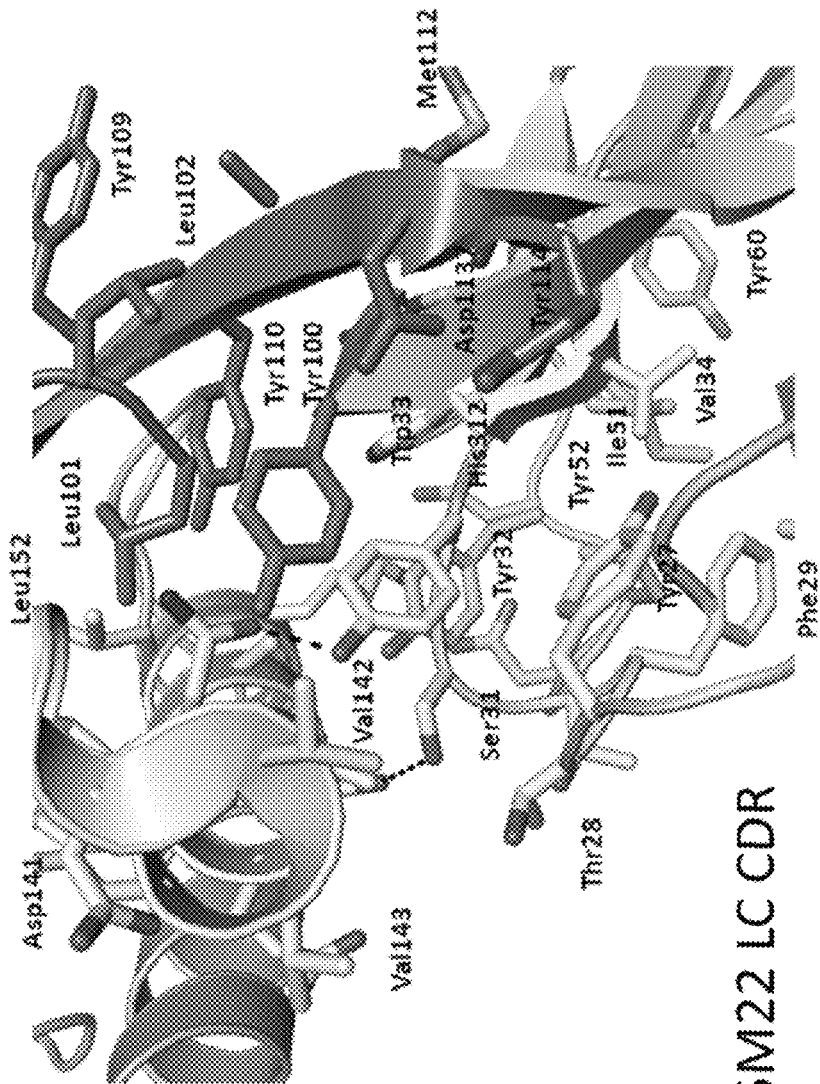
FIG. 48 shows a ribbon diagram illustrating the interaction of a GFRAL 25M22 epitope and a 25M22 Fab heavy chain CDR region.

FIGS. 46-48 illustrate aspects of GFRAL interactions with 3P10 and 25M22L Fabs in ribbon diagrams with select amino acid residues shown as stick models. For example, FIG. 46 illustrates aspects of a GFRAL epitope in the vicinity of the 3P10 heavy chain CDR region. The CDR sequences of 3P10 Hc are shown in FIG. 45. As another example, FIG. 47 illustrates aspects of a GFRAL epitope in the vicinity of the 3P10 light chain CDR region. The CDR sequences of 3P10 Lc are shown in FIG. 45. As another example, FIG. 48 illustrates aspects of a GFRAL epitope in the vicinity of the 25M22 heavy chain CDR region. The CDR sequences of 25M22 Lc are shown in FIG. 45.

Figure 49:
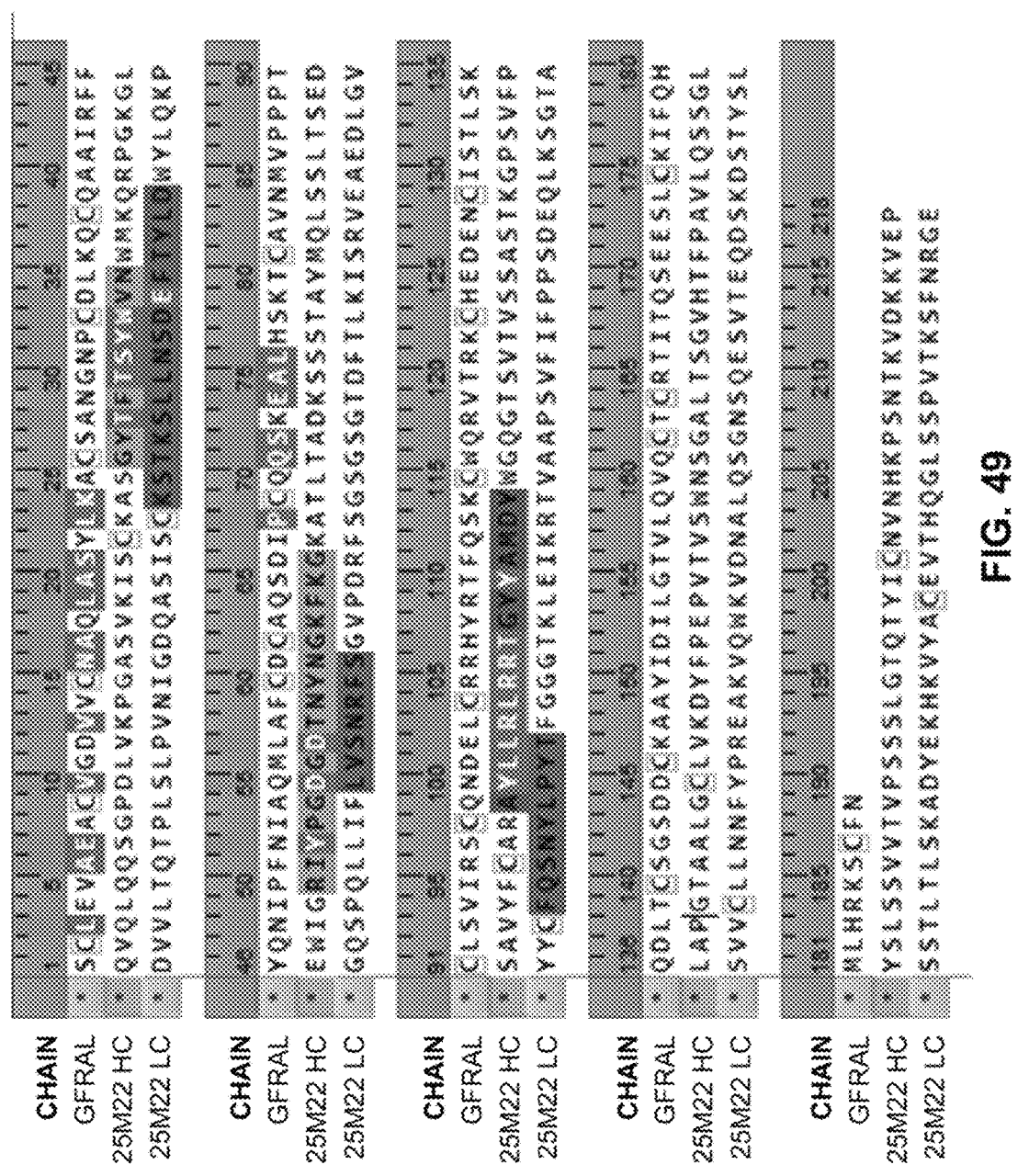

An analysis of the GFRAL epitope presented to 25M22 Fab in the 3P10 Fab::GFRAL::25M22 Fab complex crystal structure showed that 25M22's mechanism of action is that of a competitive GDF15 inhibitor and involves blocking GDF15 binding to GFRAL. Exemplary core interaction interface amino acids on the GFRAL protein and on the 25M22 Fab CDRs for the heavy and light chains are shown in FIG. 49.

Figures 50A, 50B:
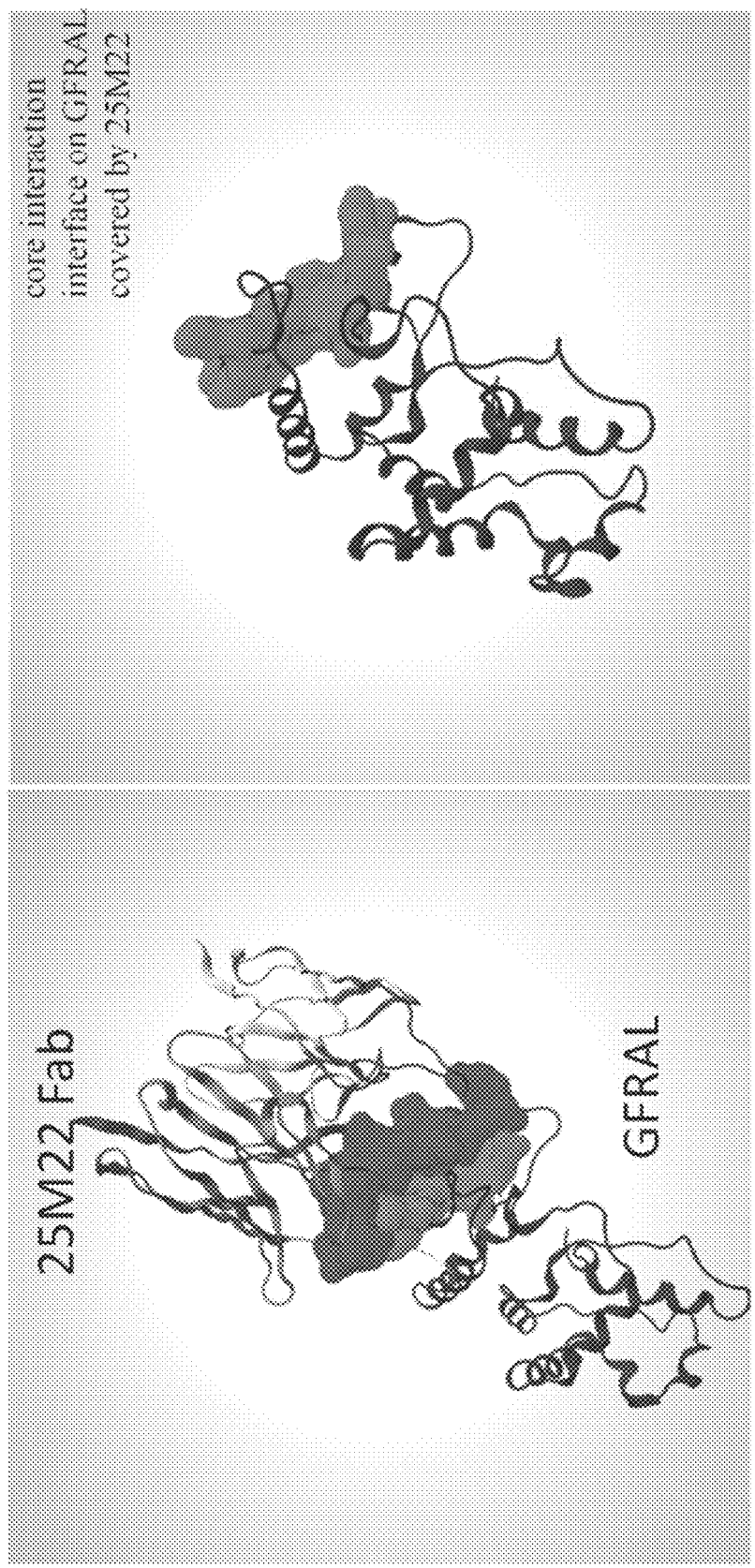
FIGS. 50A-50B illustrate core interaction interface amino acid residues on a GFRAL protein and on 25M22 Fab involved in the GFRAL/25M22 Fab interaction.

FIGS. 50A and 50B illustrates the core amino acids residues in the GFRAL/25M22 Fab interaction interface. FIG. 50A illustrates the structure of GFRAL with the core 25M22 interaction interface amino acids (binding epitope) on GFRAL highlighted in a space-filled surface model. Core interface amino acids on 25M22 CDRs for GFRAL are also highlighted in a space-filled surface model. FIG. 50B illustrates the structure of GFRAL in a ribbon diagram with core 25M22 Fab interaction interface amino acids on GFRAL (GFRAL epitope residues) highlighted in a space-filled surface model.

Figure 51:
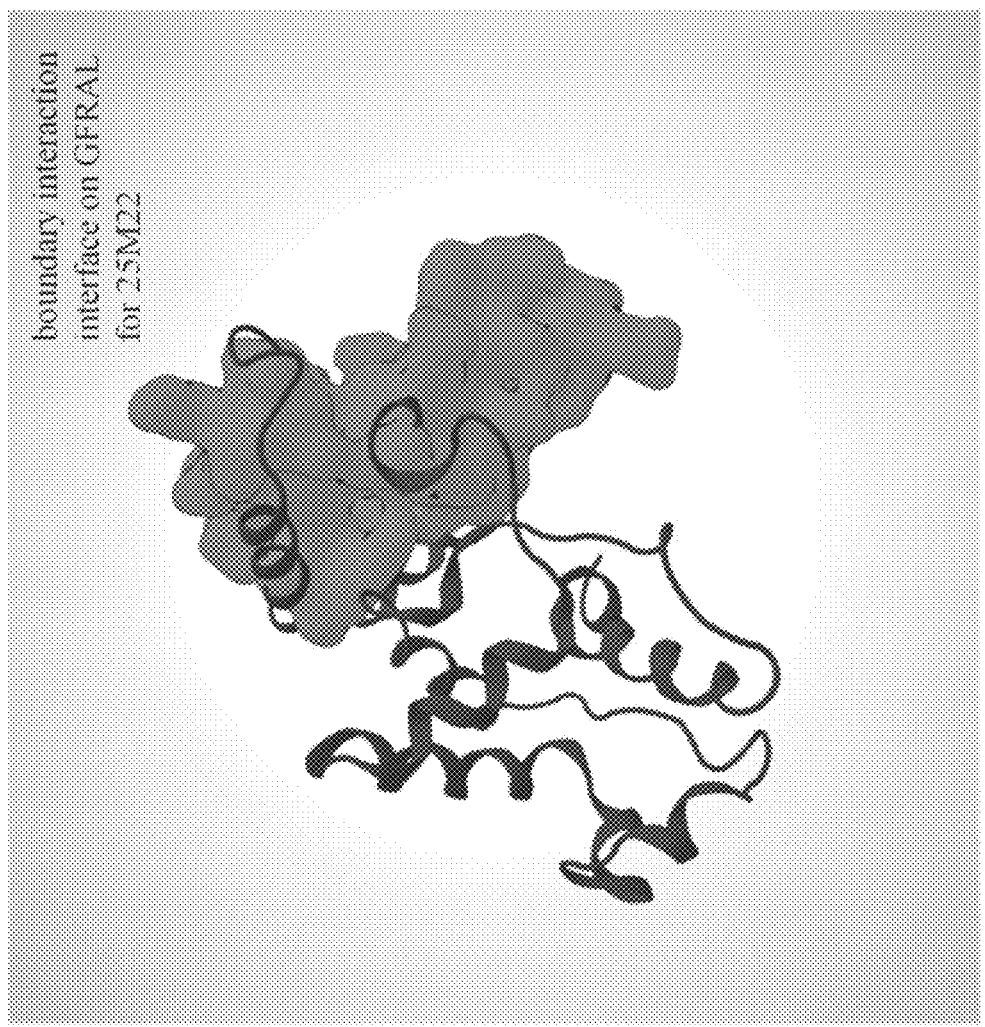
FIG. 51 illustrates boundary interaction interface amino acid residues on a GFRAL protein involved in the GFRAL/25M22 Fab interaction.

FIG. 51 illustrates boundary interaction interface amino acids on GFRAL for GFRAL/25M22 Fab binding. Boundary of interaction interface amino acids on GFRAL (for 25M22 Fab binding) are highlighted as space-filled surface models.

Figure 52:
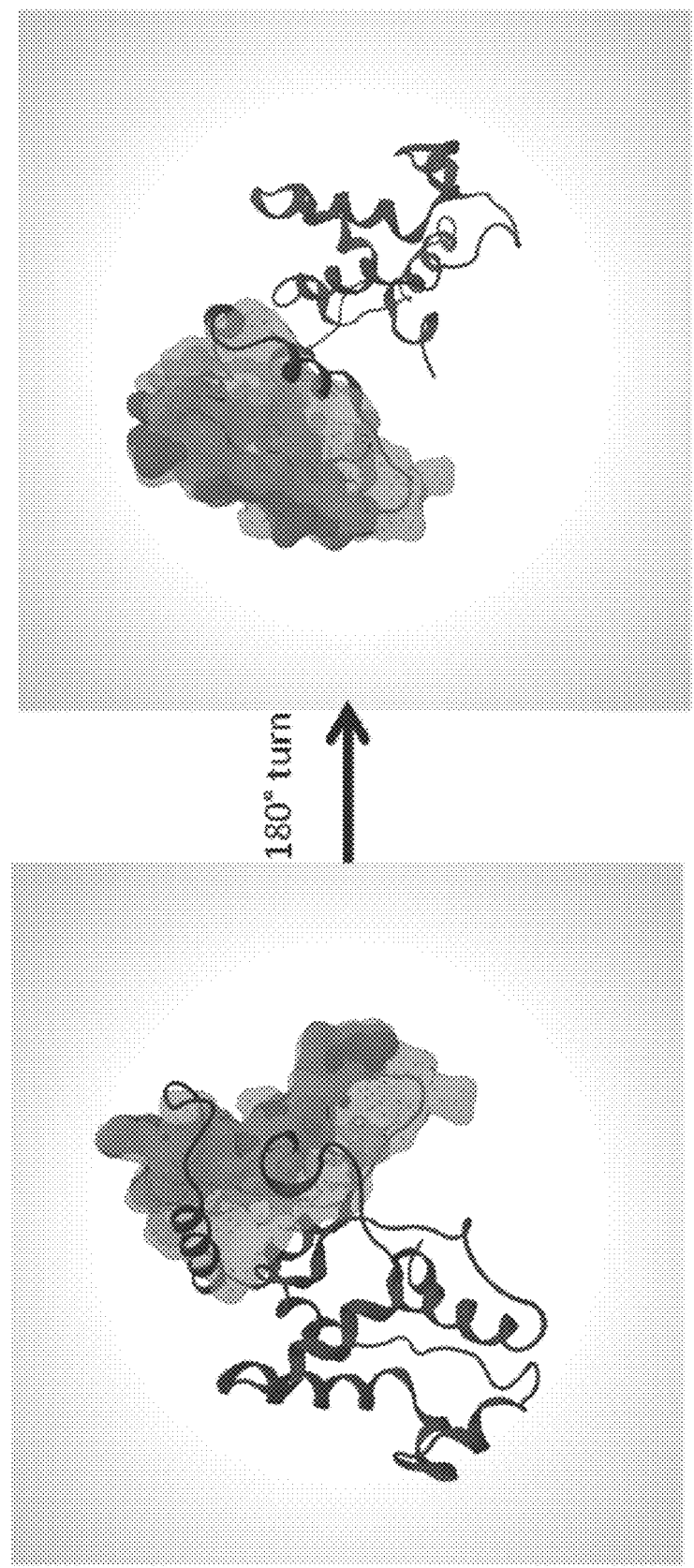
FIG. 52 shows exemplary side views of a ribbon diagram illustrating overlapping 25M22 Fab and GDF15 epitopes on a GFRAL protein as space-filled surface models (core interaction interface amino acids).
Figure 53:
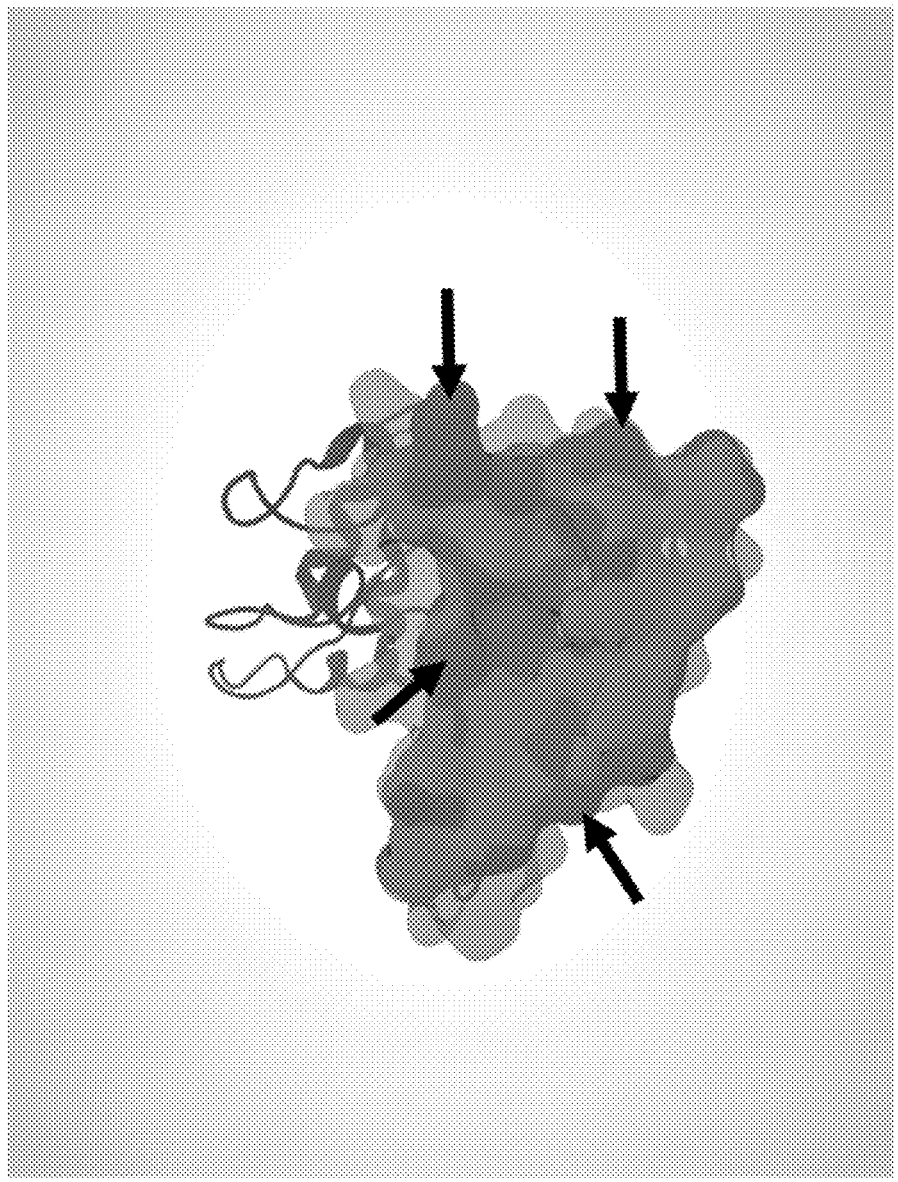
FIG. 53 shows a top view of a ribbon diagram illustrating overlapping 25M22 Fab and GDF15 epitopes on a GFRAL protein as space-filled surface models (core interaction interface amino acids).

FIGS. 52-53 illustrate the overlap of GFRAL epitopes for 25M22 Fab and GDF15 binding on GFRAL. Two side views of a GFRAL ribbon diagram are shown in the left and right panels of FIG. 52. FIG. 53 shows a top view of the overlapping GFRAL epitopes for 25M22 Fab and GDF15 binding. Core interaction interface amino acids residues on GFRAL for 25M22 Fab and GDF15 binding are highlighted in a space-filled surface model. Light gray surface shading represents GFRAL surface covered by 25M22 Fab, whereas dark gray surface shading (highlighted by black arrows) shows GFRAL surface covered by GDF15.

GFRAL amino acids at the interface of the GFRAL/25M22 Fab complex are shown in Table 45. To compare the interaction interface amino acids in GFRAL/25M22 Fab and GFRAL/GDF15 complexes, Table 45 further lists the GFRAL amino acids at the interface of the GFRAL/GDF15 complex, which is also shown in Table 38. Table 45 illustrates that all core interaction interface amino acid residues on GFRAL that bind to GDF15 are also core interaction interface amino acids in the GFRAL/25M22 Fab interaction.

The amino acid sequence of a full-length precursor human GFRAL protein is shown below (see also Example 12, part C):

```
GFRAL sequences
                                        SEQ ID NO: 1797
         10         20         30         40
    MIVFIFLAMG LSLENEYTSQ TNNCTYLREQ CLRDANGCKH 50         60         70         80
    AWRVMEDACN DSDPGDPCKM RNSSYCNLSI QYLVESNFQF 90        100        110        120
    KECLCTDDFY CTVNKLLGKK CINKSDNVKE DKFKWNLTTR 130        140        150        160
    SHHGFKGMWS CLEVAEACVG DVVCNAQLAS YLKACSANGN 170        180        190        200
    PCDLKQCQAA IRFFYQNIPF NIAQMLAFCD CAQSDIPCQQ 210        220        230        240
    SKEALHSKTC AVNMVPPPTC LSVIRSCQND ELCRRHYRTF 250        260        270        280
    QSKCWQRVTR KCHEDENCIS TLSKQDLTCS GSDDCKAAYI 290        300        310        320
    DILGTVLQVQ CTCRTITQSE ESLCKIFQHM LHRKSCFNYP
```

```
              330        340        350        360
       TLSNVKGMAL YTRKHANKIT LTGFHSPFNG EVIYAAMCMT 370        380        390
       VTCGILLLVM VKLRTSRISS KARDPSSIQI PGEL
```

TABLE 45

| Residues on GFRAL that bind to GDF15 | Residues on GFRAL that bind to 25M22 | |
|---|---|---|
| Core interaction interface amino acids | Core interaction interface amino adds | Boundary interaction interface amino acids |
| LEU132 | LEU132 | SER130 |
| ALA135 | ALA135 | CYS131 |
| GLU136 | GLU136 | LEU132 |
| VAL139 | VAL139 | GLU133 |
| GLY140 | GLY140 | VAL134 |
| VAL142 | VAL142 | ALA135 |
| ASN145 | ASN145 | GLU136 |
| ALA146 | ALA146 | ALA137 |
| LEU148 | LEU148 | CYS138 |
| ALA149 | ALA149 | VAL139 |
| LEU152 | LEU152 | GLY140 |
| LYS153 | LYS153 | ASP141 |
| ILE196 | ILE196 | VAL142 |
| PRO197 | PRO197 | VAL143 |
| GLN200 | GLN200 | CYS144 |
| SER201 | SER201 | ASN145 |
| ALA204 | ALA204 | ALA146 |
| LEU205 | LEU205 | GLN147 |
|  |  | LEU148 |
|  |  | ALA149 |
|  |  | SER150 |
|  |  | TYR151 |
|  |  | LEU152 |
|  |  | LYS153 |
|  |  | ALA154 |
|  |  | CYS155 |
|  |  | SER156 |
|  |  | PHE174 |
|  |  | TYR175 |
|  |  | LEU186 |
|  |  | CYS189 |
|  |  | CYS191 |
|  |  | ALA192 |
|  |  | GLN193 |
|  |  | SER194 |
|  |  | ASP195 |
|  |  | ILE196 |
|  |  | PRO197 |
|  |  | CYS198 |
|  |  | GLN199 |
|  |  | GLN200 |
|  |  | SER201 |
|  |  | LYS202 |
|  |  | GLU203 |
|  |  | ALA204 |
|  |  | LEU205 |
|  |  | HIS206 |
|  |  | SER207 |

*GFRAL amino acid numbering according to SEQ ID NO: 1797

Figure 54:
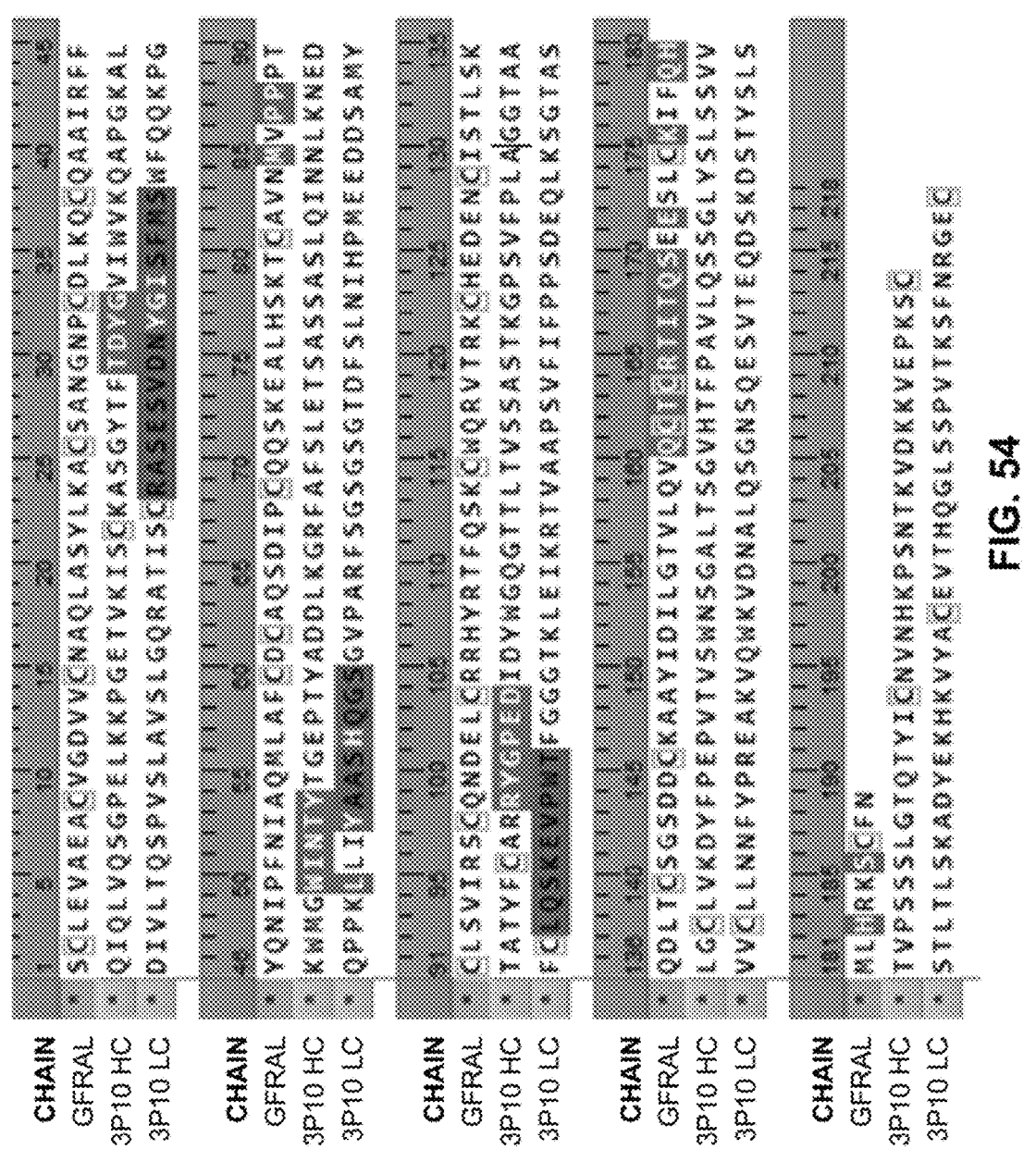

An analysis of the GFRAL epitope presented to 3P10 Fab in the 3P10 Fab::GFRAL::25M22 Fab complex crystal structure showed that 3P10's mechanism of action is that of a non-competitive GDF15 inhibitor and does not involve blocking GDF15-binding to GFRAL. Exemplary core interaction interface amino acids on the GFRAL protein and on the 3P10 Fab CDRs for the heavy and light chains are shown in FIG. 54.

Figures 55A, 55B:
FIGS. 55A-55B show a ribbon diagram illustrating a crystal structure of a GFRAL/3P10 Fab complex. Interaction interface residues are shown as stick models (FIG. 55A) or space-filled surface models (FIG. 55B).

FIGS. 55A-55B illustrate the interaction interface residues on GFRAL and 3P10 Fab as stick models (FIG. 55A) or a space-filled surface models (FIG. 55B).

Figure 56B:
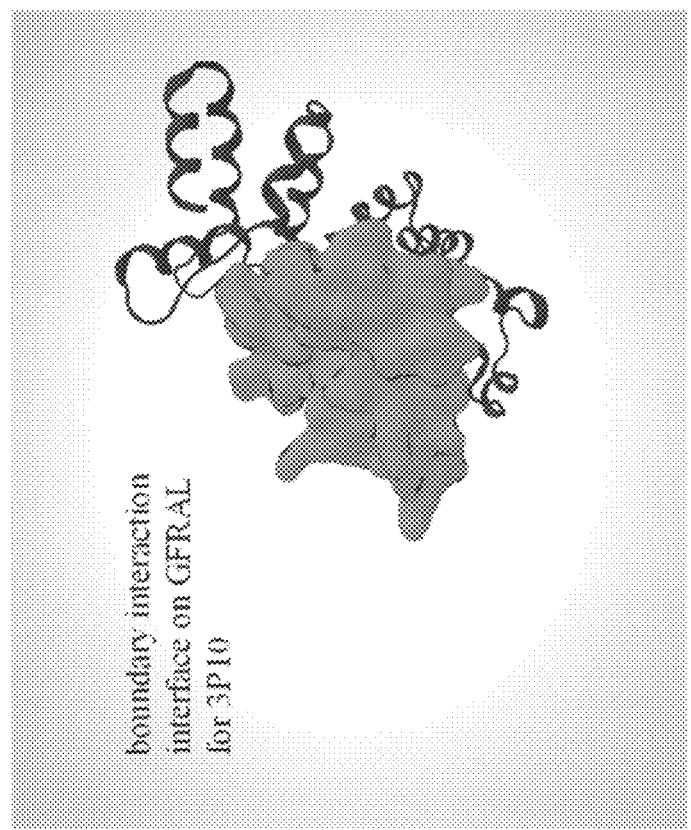
FIGS. 56A-56B illustrates interface residues of a GFRAL 3P10 Fab epitope as space-filled surface models in a ribbon diagram of GFRAL.
Figure 56A:
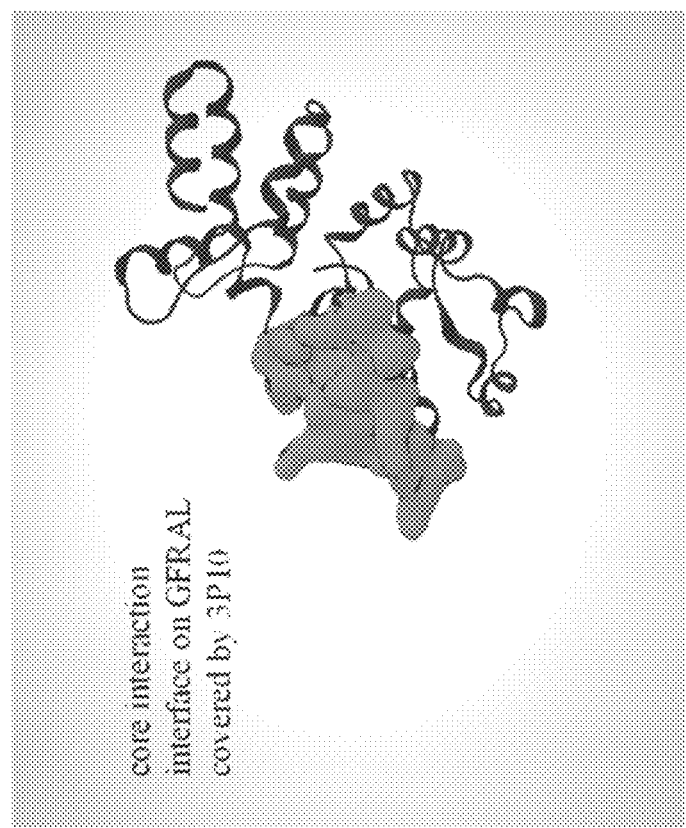

FIGS. 56A-56B illustrates core (FIG. 56A) and boundary (FIG. 56B) interaction interface amino acids on GFRAL for 3P10 Fab binding (GFRAL structural 3P10 binding epitope) in a space-filled surface model.

Figure 57:
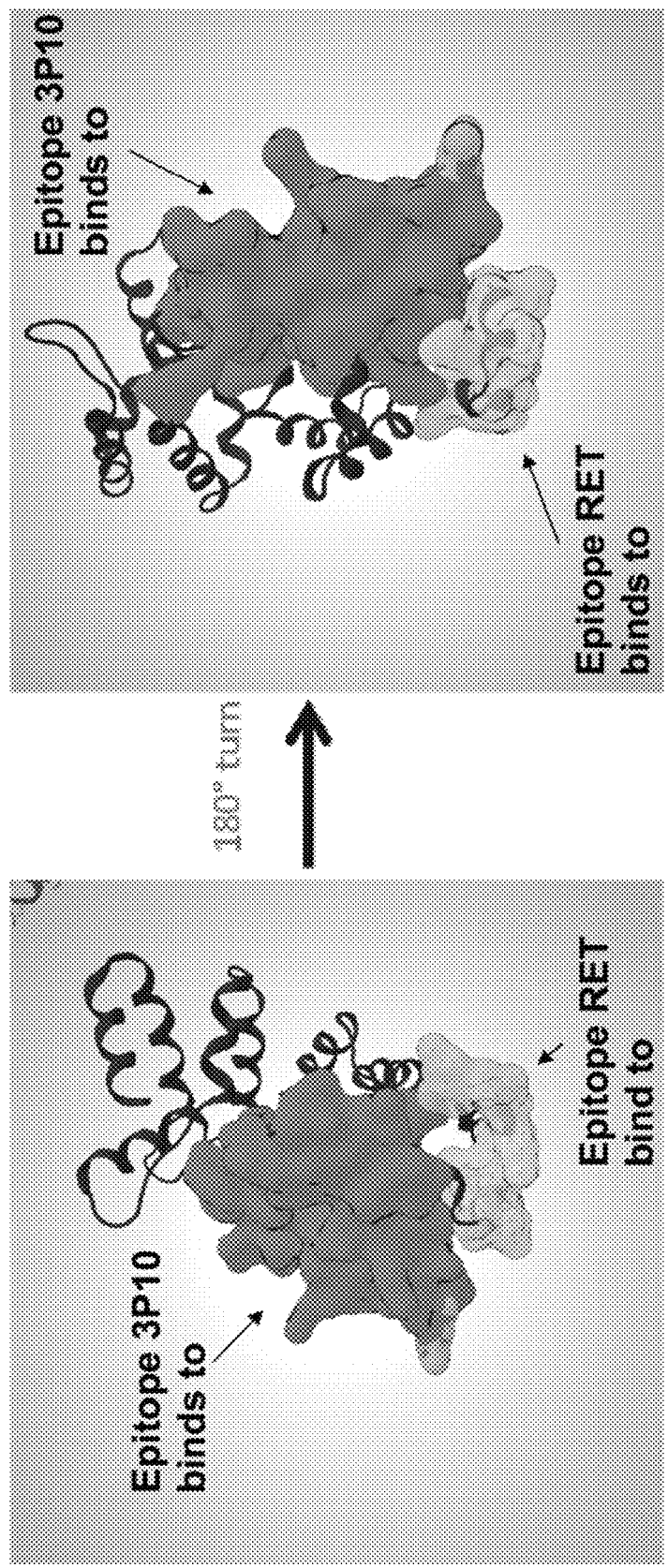
FIG. 57 illustrates overlapping residues of a GFRAL protein that bind to 3P10 Fab and residues of a GFRAL-protein that bind to a RET protein as space-filled surface models on a ribbon diagram of a GFRALprotein.

FIG. 57 illustrates the partial overlap of GFRAL epitopes for 3P10 Fab and RET on GFRAL. Two side views of a GFRAL ribbon diagram are shown in the left and right panels of FIG. 57. Interaction interface amino acids residues on GFRAL for 3P10 Fab and RET binding are highlighted in a space-filled surface model.

Figure 58:
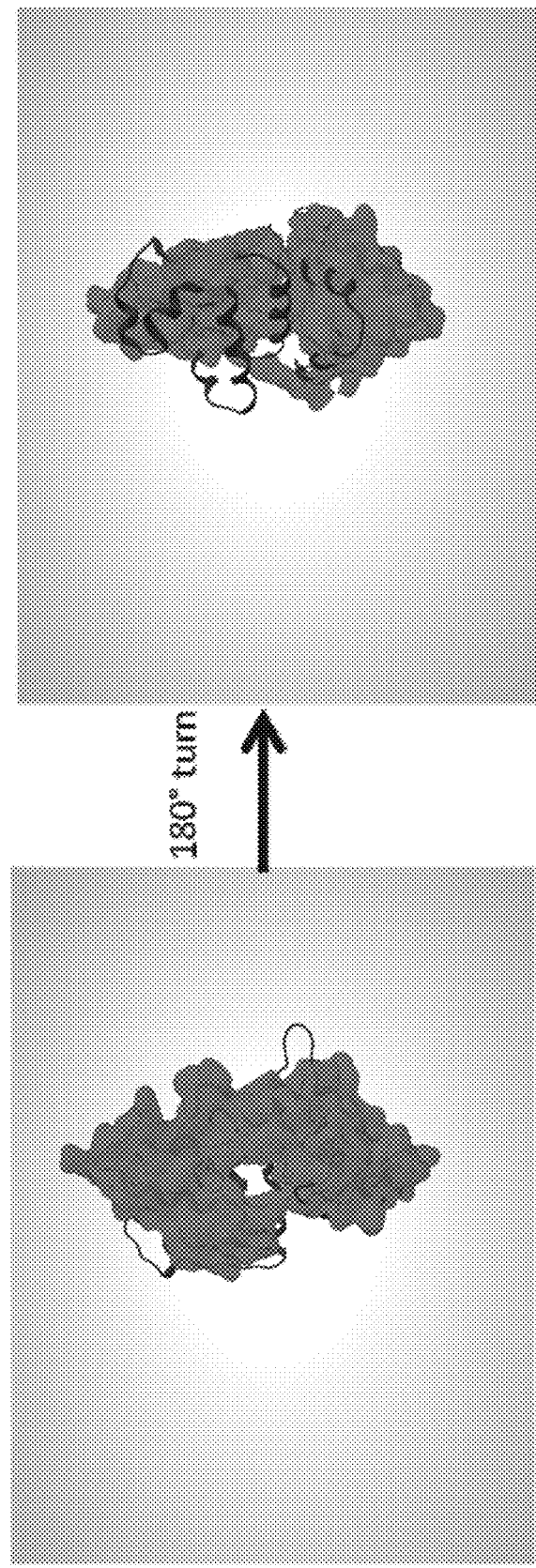
FIG. 58 illustrates the combined coverage of boundary interaction interface residues of a GFRAL protein that bind to 3P10 Fab and 25M22 Fab.

FIG. 58 illustrates the overlap of GFRAL epitopes for 25M22 Fab and 25M22 Fab binding on GFRAL. Top and a bottom views of a GFRAL ribbon diagram are shown on the left (top view) and right (bottom view) panels of FIG. 58. Boundary interaction interface residues on GFRAL involved in 25M22 Fab and 25M22 Fab binding are shown as space-filled surface models.

GFRAL amino acids at the interface of the GFRAL/3P10 Fab complex are shown in Table 46. To compare the interaction interface amino acids in GFRAL/3P10 Fab and GFRAL/RET complexes, Table 446 further lists the GFRAL amino acids at the interface of the GFRAL/RET complex, which is also shown in Table 40A. Table 46 shows core interaction interface amino acid residues on GFRAL that bind to both RET and 3P10 Fab in bold.

TABLE 46

| Residues on GFRAL that bind to RET in RET/GFRAL/GDF15 Model | Residues on GFRAL that bind to 3P10 in 3P10/GFRAL structure | |
|---|---|---|
| Core interaction interface amino acids | Core interaction interface amino acids | Boundary interaction interface amino acids |
| Gln246 | MET214 | LEU164 |
| Arg247 | PRO216 | LYS208 |
| Arg250 | PRO217 | VAL212 |
| Lys251 | GLN290 | ASN213 |
| Cys252 | CYS291 | MET214 |
| Asp255 | THR292 | VAL215 |
| Glu256 | CYS293 | PRO216 |
| Asn257 | ARG294 | PRO217 |
| Cys258 | THR295 | PRO218 |
| Ile259 | ILE296 | THR219 |
| Ser260 | THR297 | CYS220 |
| Thr261 | GLN298 | LEU221 |
| Leu262 | SER299 | VAL223 |
| Thr297 | GLU301 | TRP245 |
| Gln298 | LYS305 | LEU267 |
| Ser299 | GLN308 | CYS269 |
|  | HIS309 | GLN288 |
|  | HIS312 | VAL289 |
|  | SER315 | GLN290 |
|  |  | CYS291 |
|  |  | THR292 |
|  |  | CYS293 |
|  |  | ARG294 |
|  |  | THR295 |
|  |  | ILE296 |
|  |  | THR297 |
|  |  | GLN298 |

TABLE 46-continued

| Residues on GFRAL that bind to RET in RET/GFRAL/GDF15 Model Core interaction interface amino acids | Residues on GFRAL that bind to 3P10 in 3P10/GFRAL structure | |
|---|---|---|
| | Core interaction interface amino acids | Boundary interaction interface amino acids |
| | | SER299 |
| | | GLU300 |
| | | GLU301 |
| | | SER302 |
| | | LEU303 |
| | | CYS304 |
| | | LYS305 |
| | | ILE306 |
| | | PHE307 |
| | | GLN308 |
| | | HIS309 |
| | | MET310 |
| | | LEU311 |
| | | HIS312 |
| | | ARG313 |
| | | LYS314 |
| | | SER315 |
| | | CYS316 |
| | | PHE317 |

Core interaction interface amino acid residues on GFRAL that bind to both RET and 3P10 Fab are shown in bold.

C1: Crystal Structure of GFRAL/8D8/5F12 Fab Complex

The crystal structure of a 8D8 Fab::GFRAL::5F12 Fab complex was determined.

8D8 Fab and 5F12 Fab amino acid sequences are shown below, with VH and VL sequences bolded and CDR regions bolded and underlined.

```
8D8 Fab Hc:
                                          (SEQ ID NO: 1828)
QVQLKESGPGLVAPSQSLSITCTVSGFSLSRYSVHWVRQPPGKGLEWLGMIWGFGS

TDYNSALKSRLSITKDNSKSQFFLKMNSLQTDDTAMYYCARIHTTAGSYWGQGTLVT

VSAASTKGPSVFPLAPSSKSTSGGTAALGCLVKDYFPEPVTVSWNSGALTSGVHTFPA

VLQSSGLYSLSSVVTVPSSSLGTQTYICNVNHKPSNTKVDKKVEPKSCDEVDG

8D8 Fab Lc:
                                          (SEQ ID NO: 1829)
DIVMTQSQKFMSTSIGDRVSVTCKASQNVGTNVAWYQQKPGQSPKALVYSTSYRYS

GVPDRFTGSGSGTDFTLTISNVQSEDLAEYFCHQYNSYPLTFGAGTKLELKRTVAAP

SVFIFPPSDEQLKSGTASVVCLLNNFYPREAKVQWKVDNALQSGNSQESVTEQDSKD

STYSLSSTLTLSKADYEKHKVYACEVTHQGLSSPVTKSFNRGEC

5F12 Fab Hc:
                                          (SEQ ID NO: 1830)
QVQLKQSGTELVRPGASVKLSCKASGYTFTDYYINWVKQRPGQGLEWIARIYPGNG

NTYHNEKFKGKATLTAEKSSSTAYMQLSSLTSEDSAVYFCAREGLYYDYDRYFDYW

GQGTALTVSSASTKGPSVFPLAPSSKSTSGGTAALGCLVKDYFPEPVTVSWNSGALT

SGVHTFPAVLQSSGLYSLSSVVTVPSSSLGTQTYICNVNHKPSNTKVDKKVEPKSCDE

VDG

5F12 Fab Lc:
                                          (SEQ ID NO: 1831)
NIVLTQSPASLAVSLGQRATISCRASESVDTYGNSFMHVVYQQKPGQPPKLLIYLASN
0
LESGVPARFSGSGSRTDFTLTIDPVEADDAATYYCHQNNEDPPAFGGGTKLEIKRTV

AAPSVFIFPPSDEQLKSGTASVVCLLNNFYPREAKVQWKVDNALQSGNSQESVTEQD

SKDSTYSLSSTLTLSKADYEKHKVYACEVTHQGLSSPVTKSFNRGEC
```

Figure 59:
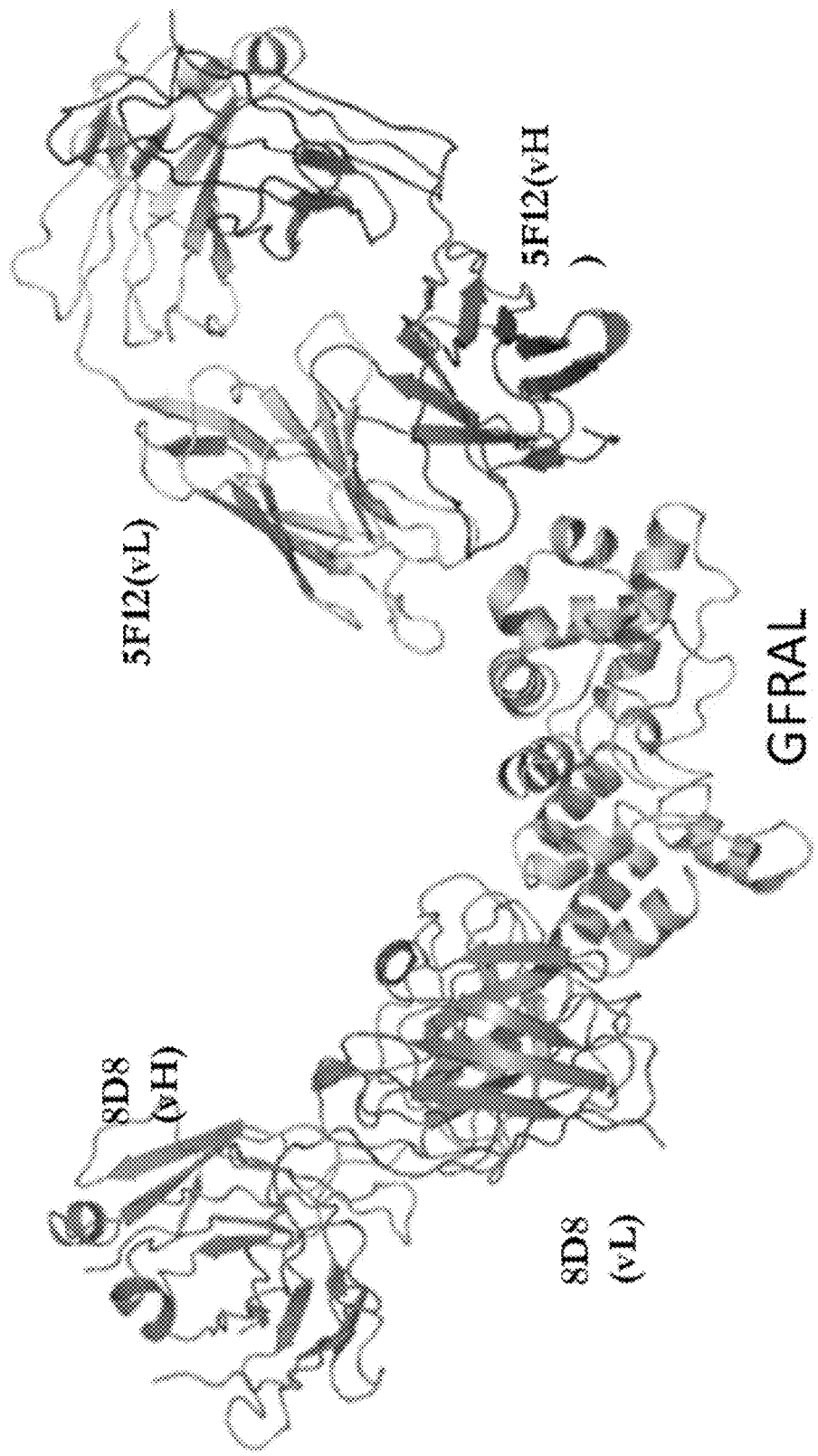
FIG. 59 shows an exemplary ribbon diagram of a GFRAL/8D8/5F12 Fab complex formed in an asymmetric GFRAL/8D8/5F12 Fab complex crystal unit.
Figure 60:
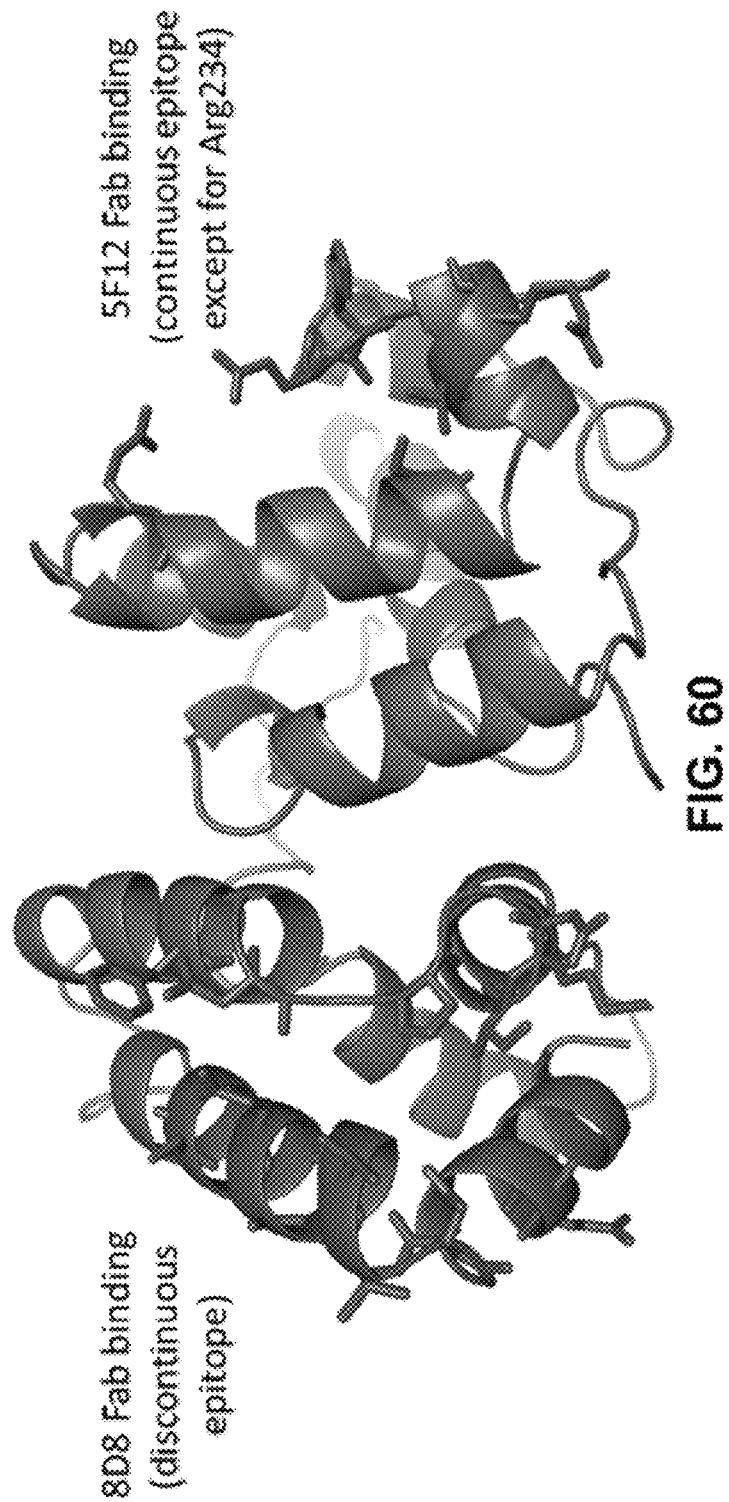
FIG. 60 shows an exemplary ribbon diagram of the 8D8 Fab and 5F12 Fab binding sites on a GFRAL protein. Residues on the GFRAL protein that are important for Fab binding are shown as stick models.

FIG. 59 illustrates an aspect of a 3P10 Fab::GFRAL::25M22 Fab complex by a ribbon diagram. The Fab fragments interact with an asymmetric unit of GFRAL in the 3P10 Fab::GFRAL::25M22 Fab complex crystal. The crystal structure also showed that GFRAL epitope residues 290-312 were presented to the 3P10 antibody and GFRAL N-terminal epitope residues 130-157 were presented to the 25M22 antibody heavy chain CDR regions FIG. 60 illustrates 8D8 Fab and 5F12 Fab binding sites on the GFRAL protein. Residues on the GFRAL protein that are important for Fab bindings are shown as stick models.

Figure 61:
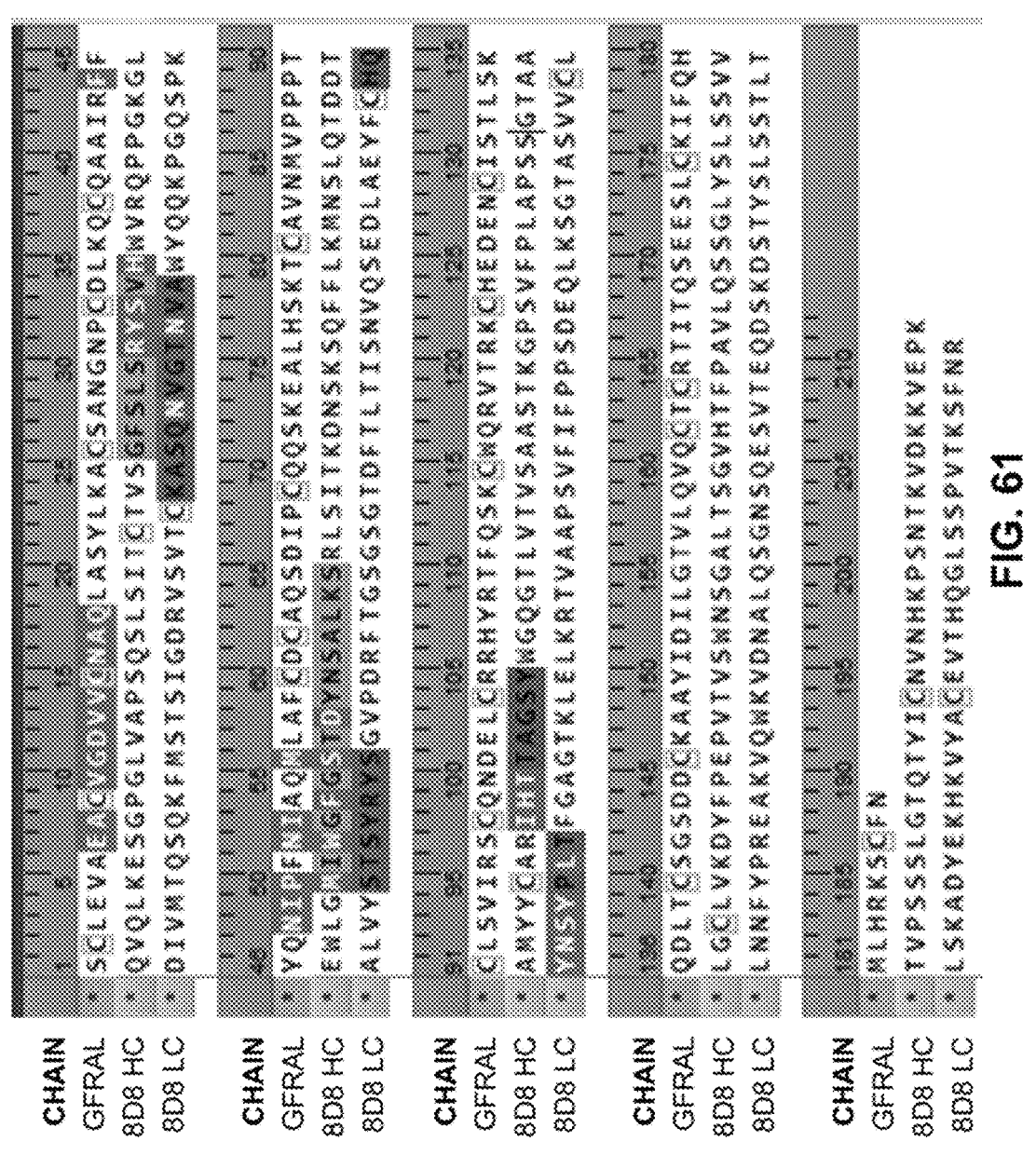

An analysis of the GFRAL epitope presented to 8D8 Fab in the 8D8 Fab::GFRAL::5F12 Fab complex crystal structure showed that 8D8's mechanism of action is that of a competitive GDF15 inhibitor and involves blocking GDF15 binding to GFRAL. Exemplary core interaction interface amino acids on the GFRAL protein and on the 8D8 Fab CDRs for the heavy and light chains are shown in FIG. 61.

Figure 62:
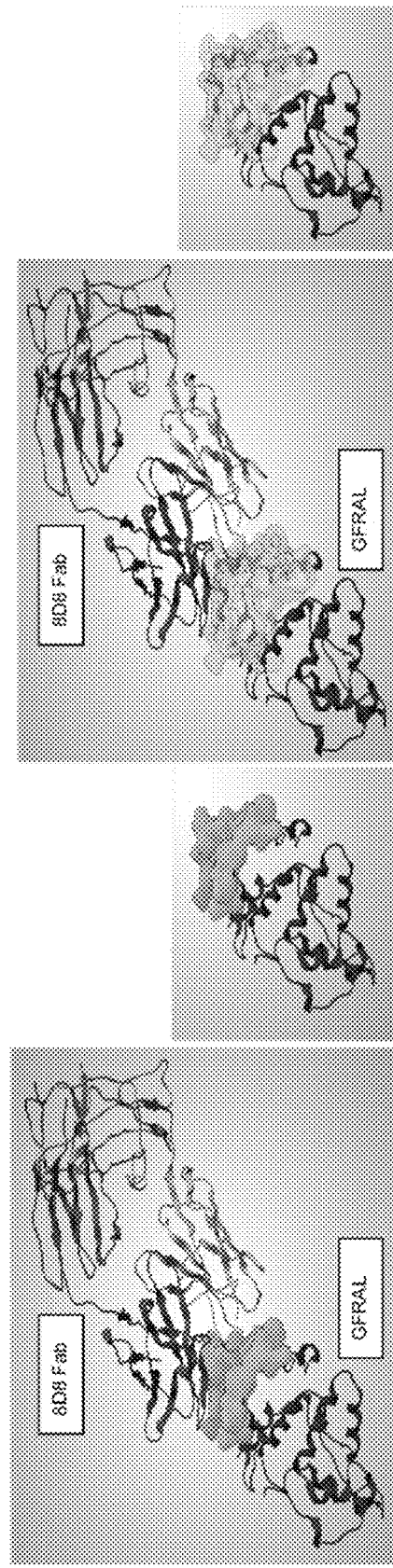
FIGS. 62A, 62B, 62C and 62D illustrate core and boundary amino acid residues in a GFRAL/8D8 Fab interaction interface.

FIGS. 62A, 62B, 62C and 62D illustrate the core and boundary amino acid residues in the GFRAL/8D8 Fab interaction interface. FIG. 62A illustrates the structure of GFRAL with the core 8D8 interaction interface amino acids (GFRAL epitope residues) on GFRAL highlighted in a space-filled surface model. FIG. 62B also illustrates the core interface amino acids on GFRAL covered by 8D8 in a space-filled surface model. FIG. 62C illustrates the structure of GFRAL in a ribbon diagram with boundary 8D8 Fab interaction interface amino acids on GFRAL (GFRAL epitope residues) highlighted in a space-filled surface model. FIG. 62D also illustrates the boundary interface amino acids on GFRAL covered by 8D8 in a space-filled surface model.

Figure 63:
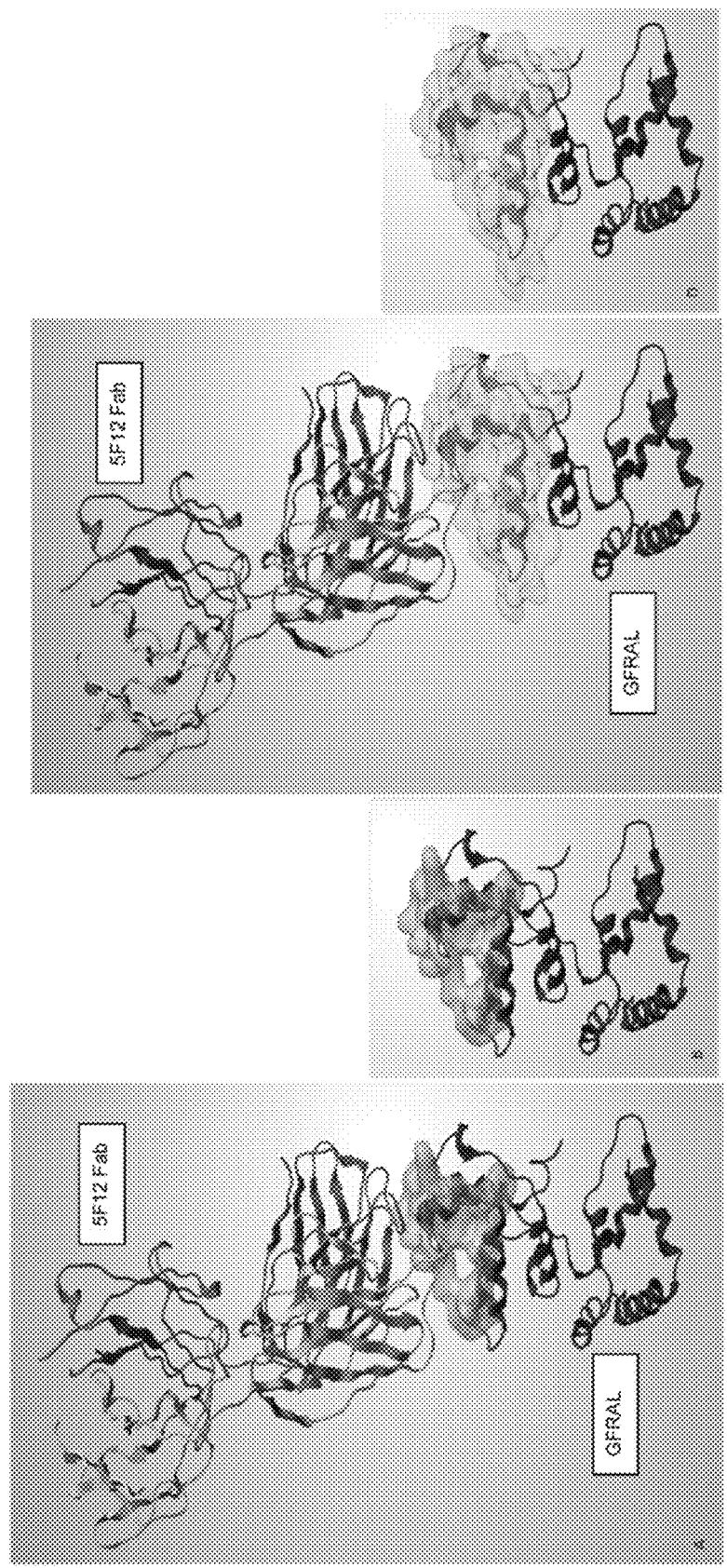
FIGS. 63A, 63B, 63C and 63D illustrate the core and boundary amino acid residues in a GFRAL/5F12 Fab interaction interface.

FIGS. 63A, 63B, 63C and 63D illustrate the core and boundary amino acid residues in the GFRAL/5F12 Fab interaction interface. FIG. 63A illustrates the structure of GFRAL with the core 5F12 interaction interface amino acids (GFRAL epitope residues) on GFRAL highlighted in a space-filled surface model. FIG. 63B also illustrates the core interface amino acids on GFRAL covered by 5F12 in a space-filled surface model. FIG. 63C illustrates the structure of GFRAL in a ribbon diagram with boundary 5F12 Fab interaction interface amino acids on GFRAL (GFRAL epitope residues) highlighted in a space-filled surface model. FIG. 63D also illustrates the boundary interface amino acids on GFRAL covered by 5F12 in a space-filled surface model.

GFRAL amino acids at the interface of the GFRAL/8D8 Fab complex are shown in Table 47. To compare the interaction interface amino acids in GFRAL/8D8 Fab and GFRAL/GDF15 complexes, Table 47 further lists the GFRAL amino acids at the interface of the GFRAL/GDF15 complex, which is also shown in Table 38. Table 47 illustrates that core interaction interface amino acid residues on GFRAL that bind to GDF15 overlaps with the core interaction interface amino acids in the GFRAL/8D8 Fab interaction.

The amino acid sequence of a full-length precursor human GFRAL protein is shown below (see also Example 12, part C):

```
GFRAL sequences
                                      SEQ ID NO: 1797
         10         20         30         40
    MIVFIFLAMG LSLENEYTSQ TNNCTYLREQ CLRDANGCKH 50         60         70         80
    AWRVMEDACN DSDPGDPCKM RNSSYCNLSI QYLVESNFQF 90        100        110        120
    KECLCTDDFY CTVNKLLGKK CINKSDNVKE DKFKWNLTTR 130        140        150        160
    SHHGFKGMWS CLEVAEACVG DVVCNAQLAS YLKACSANGN 170        180        190        200
    PCDLKQCQAA IRFFYQNIPF NIAQMLAFCD CAQSDIPCQQ 210        220        230        240
    SKEALHSKTC AVNMVPPPTC LSVIRSCQND ELCRRHYRTF 250        260        270        280
    QSKCWQRVTR KCHEDENCIS TLSKQDLTCS GSDDCKAAYI 290        300        310        320
    DILGTVLQVQ CTCRTITQSE ESLCKIFQHM LHRKSCFNYP 330        340        350        360
    TLSNVKGMAL YTRKHANKIT LTGFHSPFNG EVIYAAMCMT 370        380        390
    VTCGILLLVM VKLRTSRISS KARDPSSIQI PGEL
```

TABLE 47

| residues on GFRAL that bind to GDF15 | Residues on GFRAL that bind to 8D8 in in GFRAL/8D8 Fab structure | |
|---|---|---|
| Core interaction interface amino acids | Core interaction interface amino acids | Boundary interaction interface amino acids |
| LEU132 | Glu136 | LEU132 |
| ALA135 | Ala137 | GLU133 |
| GLU136 | Val139 | VAL134 |
| VAL139 | Gly140 | ALA135 |
| GLY140 | Asp141 | GLU136 |
| VAL142 | Val142 | ALA137 |
| ASN145 | Val143 | CYS138 |
| ALA146 | Cys144 | VAL139 |
| LEU148 | Asn145 | GLY140 |
| ALA149 | Ala146 | ASP141 |
| LEU152 | Gln147 | VAL142 |
| LYS153 | Phe173 | VAL143 |
| ILE196 | Asn177 | CYS144 |
| PRO197 | Ile178 | ASN145 |
| GLN200 | Pro179 | ALA146 |
| SER201 | Asn181 | GLN147 |
| ALA204 | Ile182 | LEU148 |
| LEU205 | Met185 | ALA149 |
|  |  | SER150 |
|  |  | TYR151 |
|  |  | PHE174 |
|  |  | TYR175 |
|  |  | ALA169 |
|  |  | ALA170 |
|  |  | ILE171 |
|  |  | ARG172 |
|  |  | PHE173 |
|  |  | GLN176 |
|  |  | ASN177 |
|  |  | ILE178 |
|  |  | PRO179 |
|  |  | PHE180 |
|  |  | ASN181 |
|  |  | ILE182 |
|  |  | ALA183 |
|  |  | GLN184 |
|  |  | MET185 |
|  |  | LEU186 |
|  |  | ALA187 |
|  |  | PHE188 |
|  |  | CYS189 |

Core interaction interface amino acid residues on GFRAL that bind to both GDF15 and 8D8 Fab are shown in bold.

Figure 64:
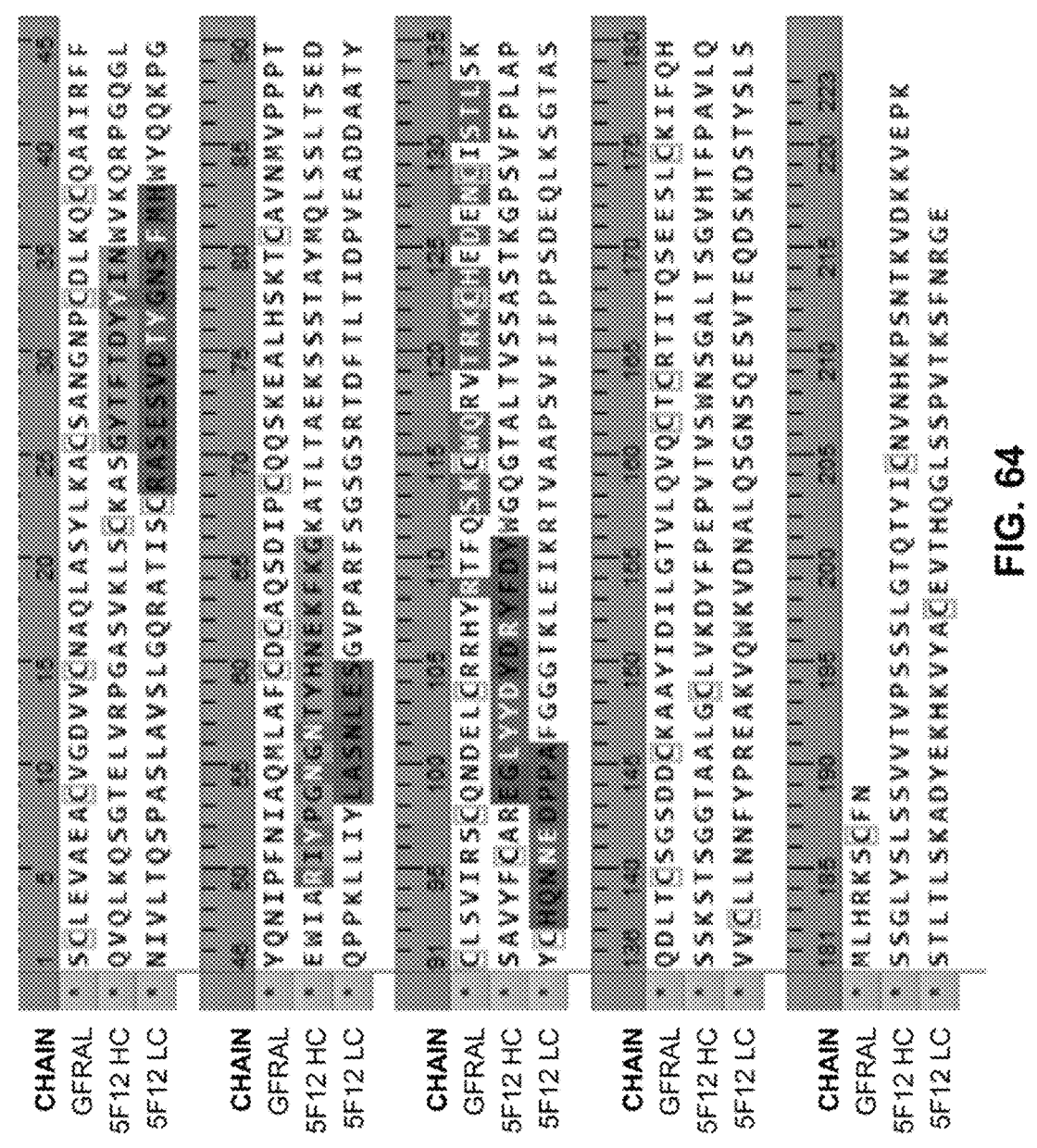

An analysis of the GFRAL epitope presented to 5F12 Fab in the 5F12 Fab::GFRAL::8D8 Fab complex crystal structure showed that 5F12's mechanism of action is that of a non-competitive GDF15 inhibitor and does not involve blocking GDF15-binding to GFRAL. Exemplary core interaction interface amino acids on the GFRAL protein and on the 5F12 Fab CDRs for the heavy and light chains are shown in FIG. 64.

GFRAL amino acids at the interface of the GFRAU5F12 Fab complex are shown in Table 48. To compare the interaction interface amino acids in GFRAU5F12 Fab and GFRAL/RET complexes, Table 48 further lists the GFRAL amino acids at the interface of the GFRAL/RET complex, which is also shown in Table 40A. Table 48 shows core interaction interface amino acid residues on GFRAL that bind to both RET and 5F12 Fab. Residues on GFRAL which are critical for GFRAU5F12 interactions: 5F12 binding epitope on GFRAL reveals a non-competitive inhibitory mechanism of action of blocking GFRAL/RET interactions.

TABLE 48

| residues on GFRAL that bind to RET in RET/GFRAL/ GDF15 Model Core interaction interface amino acids on GFRAL | residues on GFRAL that bind to 5F12 in 5F12/GFRAL structure | |
|---|---|---|
| | Core interaction interface amino acids | Boundary interaction interface amino acids |
| Gln246 | Arg234 | CYS233 |
| Arg247 | Arg238 | ARG234 |
| Arg250 | GLN241 | ARG235 |
| Lys251 | Ser242 | HIS236 |
| Cys252 | Lys243 | TYR237 |
| Asp255 | Trp245 | ARG238 |
| Glu256 | Gln246 | THR239 |
| Asn257 | Thr249 | PHE240 |
| Cys258 | Arg250 | GLN241 |
| Ile259 | Lys251 | SER242 |
| Ser260 | Cys252 | LYS243 |
| Thr261 | His253 | CYS244 |
| Leu262 | Asp255 | TRP245 |
| Thr297 | Asn257 | GLN246 |
| Gln298 | Cys258 | ARG247 |
| Ser299 | Ser260 | VAL248 |
| | Thr261 | THR249 |
| | Leu262 | ARG250 |
| | | LYS251 |
| | | CYS252 |
| | | HIS253 |
| | | GLU254 |
| | | ASP255 |
| | | GLU256 |
| | | ASN257 |
| | | CYS258 |
| | | ILE259 |
| | | SER260 |
| | | THR261 |

TABLE 48-continued

| residues on GFRAL that bind to RET in RET/GFRAL/ GDF15 Model Core interaction interface amino acids on GFRAL | residues on GFRAL that bind to 5F12 in 5F12/GFRAL structure | |
|---|---|---|
| | Core interaction interface amino acids | Boundary interaction interface amino acids |
| | | LEU262 |
| | | SER263 |
| | | LYS264 |
| | | ASP266 |
| | | LEU267 |
| | | THR268 |
| | | SER272 |
| | | ASP274 |
| | | CYS275 |
| | | ALA278 |
| | | CYS269 |
| | | SER270 |
| | | SER302 |
| | | LEU303 |
| | | ILE306 |
| | | HIS309 |
| | | LEU311 |
| | | MET310 |
| | | SER315 |
| | | CYS316 |

The contents of all references described herein are hereby incorporated by reference.

Other embodiments are within the following claims.

Lengthy table referenced here

US10174119-20190108-T00001

Please refer to the end of the specification for access instructions.

Lengthy table referenced here

US10174119-20190108-T00002

Please refer to the end of the specification for access instructions.

Lengthy table referenced here

US10174119-20190108-T00003

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US10174119B2). An electronic copy of the table will also be available from the USPTO upon request and payment of the fee set forth in 37 CFR 1.19(b)(3).

SEQUENCE LISTING (2008 sequences)

SEQ ID NO: 1 - protein, 121 aa, Artificial Sequence
  VH sequence - 1C1
QMQLKQSGPGLVQPSQSLSITCTVSGFSLNDYGVHWIRQSPGKGLEWLGVIWSGGRTDYNAAFISRLSISKDNSKSQVFFKMSSLQPQDTAIYYCARWALYFLYGGSMDYWGQGTSVTVSS

SEQ ID NO: 2 - protein, 113 aa, Artificial Sequence
  VL sequence - 1C1
DVVLTQTPLSLPVSPGDQASISCRSSQSLVHSSGITYLHWYLQKPGQSPKLLIYKLSNRFSGVPDRFSGSGSGTDFTLKISRVEAEDLGVYFCSQSTHVPPWTFGGGTKLEIK

SEQ ID NO: 3 - protein, 118 aa, Artificial Sequence
  VH sequence - 3P10
QIQLVQSGPELKKPGETVKISCKASGYTFTDYGVIWVKQAPGKALKWMGWINTYTGEPTYADDLKGRFAFSLETSASSASLQINNLKNEDTATYFCARRYGPEDIDYWGQGTTLTVSS

SEQ ID NO: 4 - protein, 111 aa, Artificial Sequence
  VL sequence - 3P10
DIVLTQSPVSLAVSLGQRATISCRASESVDNYGISFMSWFQQKPGQPPKLLIYAASHQGSGVPARFSGSGSGTDFSLNIHPMEEDDSAMYFCLQSKEVPWTFGGGTKLEIK

SEQ ID NO: 5 - protein, 114 aa, Artificial Sequence
  VH sequence - 12A3
QIQLVQSGPELKKPGETVKISCKASGYPFTIYGMNWVEQAPGKGLKWMGWINTYSGVPTYADDFKGRFAFSLETSASTAYLQINNLKDEDTATYFCASATGNYWGQGTTLTVSS

SEQ ID NO: 6 - protein, 107 aa, Artificial Sequence
  VL sequence - 12A3
DIQMTQSPSSLSASLGERVSLTCRASQDIGSSLNWLQQEPDGTIKRLIYATSSLDSGVPKRFSGSRSGSDYSLTISSLESEDFVDYYCLQYASSPYTFGGGTKVEIK

SEQ ID NO: 7 - protein, 122 aa, Artificial Sequence
  VH sequence - 5F12
QVQLKQSGTELVRPGASVKLSCKASGYTFTDYYINWVKQRPGQGLEWIARIYPGNGNTYHNEKFKGKATLTAEKSSSTAYMQLSSLTSEDSAVYFCAREGLYYDYDRYFDYWGQGTALTVSS

SEQ ID NO: 8 - protein, 111 aa, Artificial Sequence
  VL sequence - 5F12
NIVLTQSPASLAVSLGQRATISCRASESVDTYGNSFMHWYQQKPGQPPKLLIYLASNLESGVPARFSGSGSRTDFTLTIDPVEADDAATYYCHQNNEDPPAFGGGTKLEIK

SEQ ID NO: 9 - protein, 118 aa, Artificial Sequence
  VH sequence - 5A20
QVQLQQSGPELMKPGASVILSCKAIGYTFTDYWIEWVKERPGHGLEWIGEILLGSDSIHFNEKFKGKATISADTSSNTAYMQLSSLTTEDSAIYYCVRQDWNWYFDVWGTGTTVTVSS

SEQ ID NO: 10 - protein, 112 aa, Artificial Sequence
  VL sequence - 5A20
DVVMTQTPLTLSVTIGHPASISCKSSQSLLDFDGKTYLNWLFQRPGQSPKRLFYLVSKLDSGVPDRFTGSGSGTDFTLKISRVEAEDLGVYYCWQGTHFPRTFGGGTKLEIK

SEQ ID NO: 11 - protein, 116 aa, Artificial Sequence
  VH sequence - 8D8
QVQLKESGPGLVAPSQSLSITCTVSGFSLSRYSVHWVRQPPGKGLEWLGMIWGFGSTDYNSALKSRLSITKDNSKSQFFLKMNSLQTDDTAMYYCARIHTTAGSYWGQGTLVTVSA

SEQ ID NO: 12 - protein, 107 aa, Artificial Sequence
  VL sequence - 8D8
DIVMTQSQKFMSTSIGDRVSVTCKASQNVGTNVAWYQQKPGQSPKALVYSTSYRYSGVPDRFTGSGSGTDFTLTISNVQSEDLAEYFCHQYNSYPLTFGAGTKLELK

SEQ ID NO: 13 - protein, 118 aa, Artificial Sequence
  VH sequence - 17J16
QVQLQQSGAELAKPGASVKMSCKTSGYTFTDYWIHWVKQRPGQGLEWIGYINPNSNYAEYNQKFKVKATLTADKSSSTAYLQLSRLTSEDSAVYYCARFDWNWYFHVWGAGSTVTVSS

SEQ ID NO: 14 - protein, 112 aa, Artificial Sequence
  VL sequence - 17J16
DVALTQIPLTLSVTVGQPASISCKSSQSLSDSDGKTYLNWLLQKPGQSPKRLIYLVSRLGSGVPDRFTGSGSGADFTLKISRVEAEDLGVYYCWQGTHFPQTFGGGTKLEIK

SEQ ID NO: 15 - protein, 125 aa, Artificial Sequence
  VH sequence - 25M22
QVQLQQSGPDLVKPGASVKISCKASGYTFTSYWVNWMKQRPGKGLEWIGRIYPGDGDTNYNGKFKGKATLTADKSSSTAYMQLSSLTSEDSAVYFCARAYLLRLRRTGYYAMDYWGQGTSVTVSS

SEQ ID NO: 16 - protein, 112 aa, Artificial Sequence
  VL sequence - 25M22
DVVLTQTPLSLPVNIGDQASISCKSTKSLLNSDEFTYLDWYLQKPGQSPQLLIFLVSNRFSGVPDRFSGSGSGTDFTLKISRVEAEDLGVYYCFQSNYLPYTFGGGTKLEIK

SEQ ID NO: 17 - protein, 121 aa, Artificial Sequence
  VH sequence - 2B8
QIQLVQSGPELKKPGETVKISCKASGYTFTTYGMSWVKQAPGKIFKWMGWINTYSGVPTFVDDFRGRFAFSLETSASTAYLQIGNLKNEDTATYFCARRSSYYPYWYFDVWGTGTTVTVSS

SEQ ID NO: 18 - protein, 107 aa, Artificial Sequence
  VL sequence - 2B8
DIQMTQSPASLSASVGETVTITCRPSENIYSYLTWFQQEQGKSPQLLVYNAQTLAEGVPSRFSGSGSGTHFSLKINSLQPEDFGTYYCQHYYGYPFTFGSGTKLEIK

SEQ ID NO: 19 - protein, 114 aa, Artificial Sequence
  VH sequence - 22N5
QNQLVQSGPELKKPGEIVKISCKTSGYTFTDYSMHWVKKTPGKGFKWMGWINTETGEPTYADDFKGRFAFSLETSANTAHLQITNLKNEDTATYFCVKGTLNYWGQGTTLTVSS

SEQ ID NO: 20 - protein, 107 aa, Artificial Sequence
  VL sequence - 22N5
DIKMTQSPSSMYASLGERVTITCKASQDIKSYLNWFQQKPGKSPKTLIYRTKRLVDGVPSRFSGSGSGQDYSLTVSSLEYDDVGIYYCLQYVEFPLTFGDGTKLELK

SEQ ID NO: 21 - protein, 120 aa, Artificial Sequence
  VH sequence - 2I23
QAQLQQSGAELVKPGASVKLSCKASGYSFTSYNIDWVRQRPEQGLEWIGWIFPGDGSTKYNEKFKGQATLTTDKSSSTTYIHLSRLTSEDSAVYFCARSGIYYGSHFVYWGQGTLVTVSA

SEQ ID NO: 22 - protein, 112 aa, Artificial Sequence
  VL sequence - 2I23
DVVMTQTPLTLSVTIGQSASISCRSSQSLLDSDGKTYLNWLLQRPGQSPKRLIYLVSKVDSGVPDRFTGSGSGTDFTLKISRVEAEDLGVYFCWQGTHFPLTFGAGTKLELK

SEQ ID NO: 23 - protein, 120 aa, Artificial Sequence
  VH sequence - 6N16
QVQLQQSGSELVKPGTSMKLSCKASGYTFTSYNINWVRLRPEQGLEWIGWIFPGDDSIKYNENFRGKATLTTDKSSSTAYMHLSRLTSDDSAVYFCARSGIFYGNNFAYWGQGTLVTVSA

SEQ ID NO: 24 - protein, 112 aa, Artificial Sequence
  VL sequence - 6N16
DVVMTQAPLILSVTIGQPASISCKSSQSLLDGDGETYLSWLLQRPGQSPKRLIYLVSKLDSGVPDRFTGSGSGTDFTLKISRVEAEDLGVYYCCQSTHFPLTFGAGTKLELK

SEQ ID NO: 25 - protein, 119 aa, Artificial Sequence
  VH sequence - 1B3
QVHLQQPGAELVKPGASVKLSCKASGFTFTGYNINWVRLRPEQGLEWIGWIFPGDDNAKYNEKFKGKATLTTDKSSNTAYMQLSRLTSEDSAVYFCARTPVLSNYFDYWGQGTTLTVSS

SEQ ID NO: 26 - protein, 106 aa, Artificial Sequence
  VL sequence - 1B3
DIQMTQSPSSLSASLGGKVTITCKASQDISKYISWYQHKPGKSPRLLIHYTSTLQPGIPSRFSGSGSGRDYSFSISNLEPEDIATYYCLQYDNLYTFGGGTKLEIK

SEQ ID NO: 27 - protein, 125 aa, Artificial Sequence
  VH sequence - 19K19
QVQLQQSGPDLVKPGASVKISCKASGYAFTSYWMNWVKQRPGKGLEWIGRIYPGDGDTNYNGKFKGKATLTADKSSSTAYMQLSSLTSEDSAVYFCARAYLLRLRRTGYYAMDYWGQGTSVTVSS

SEQ ID NO: 28 - protein, 112 aa, Artificial Sequence
  VL sequence - 19K19
DVVLTQTPLSLPVNIGDQASISCKSTKSLLNSDEFTYLDWYLQKPGQSPQLLIYLVSNRFSGVPDRFSGSGSGTDFTLKISRVEAEDLGVYYCFQSNYLPYTFGGGTKLEIK

SEQ ID NO: 29 - protein, 118 aa, Artificial Sequence
  VH sequence - 2B3
EVKLVESGGGLVQPGGSLKLSCAASGFTFSDYFMFWVRQTPEKRLEWVAYISNDGDSTYYPDTVQGRFTISRDNAKNTLYLQMSRLRSEDTAMYYCTRQGAQATLDYWGQGTTLTVSS

SEQ ID NO: 30 - protein, 103 aa, Artificial Sequence
  VL sequence - 2B3
QIVLTQSPAIMSASLGEEITLTCSASSSVFYMHWYQQKSGTSPKLLIYSTSNLASGIPSRFSGSGSGTFYSLTISSVEAEDAADYYCHQWSSTFGGGTKLEIK

SEQ ID NO: 31 - protein, 122 aa, Artificial Sequence
  VH sequence - 8C10
QVQLQQSGVELARPGAAVKLSCKASGYTFANYGLTWVKQRTGQGLEWIGEIYPGSGHTHYNEDFKGKATLTADRSSSTAYMELRSLTSEDSAVYFCARRIQLLLPVGGFVYWGQGTLVTVSA

SEQ ID NO: 32 - protein, 107 aa, Artificial Sequence
  VL sequence - 8C10
DFVLTQSPATLSVTPGDSVSLSCRASQSISNNLHWYQQKSHESPRLLIKYASQSISGIPSRFSGSGSGTDFTLSINSVETEDFGVYFCQQSNSWPHTFGGGTKLEIK

SEQ ID NO: 33 - protein, 119 aa, Artificial Sequence
  VH sequence - 2A9
EVKLVESGGGLVKPGGSLKLSCAASGFTFSTYAMSWVRQTPEKRLEWVASITSGGTTYYTDSVKGRFTISRDNARNILYLQMSSLRSEDTAMYYCARDGNFYYYGMDYWGQGTSVTVSS

SEQ ID NO: 34 - protein, 106 aa, Artificial Sequence
  VL sequence - 2A9
DIVMTQSQKFMSTSVGDRVSITCKASQNVGTAVAWYQQKPGQSPKILIYSASNRFTGVPDRFTGSGSGTDFTLTISNMQSEDLADYFCQQYSSYFTFGGGTKLELK

SEQ ID NO: 35 - protein, 120 aa, Artificial Sequence
  VH sequence - 24G2
QVQLQQSGAELLKPGASVKLSCKASGYTFTTYWMHWVKQRPGQGLEWIGMIHPNSGSSNYNEKFKNKATLTVDKSSSTAYMQLSSLTSEDSAVYFCARSDYGFIPYFDYWGQGTTLTVSS

SEQ ID NO: 36 - protein, 108 aa, Artificial Sequence
  VL sequence - 24G2
DILLTQSPAILSVSPGERVSFSCRASQSIGTSIHWYQQRTNGSPRLLIKYASESISGIPSRFSGSGSGTDFTLIINSVESEDIADYYCQQSNSWPTFTFGAGTKLELK

SEQ ID NO: 37 - protein, 120 aa, Artificial Sequence
  VH sequence - 6G9
QVQLHQPGAELVKPGASVKLSCKTSGYTFTSYWMQWVKQRPGQGLEWIGEIDPSDSYTNYNQKFKGKATLTVDTSSTTAYMQLSSLTSEDSAVYYCARPLDRSAYYFDYWGQGTTLTVSS

SEQ ID NO: 38 - protein, 111 aa, Artificial Sequence
  VL sequence - 6G9
DIVLTQSPASLAVSLGQRATISCRASESVDFSGNSFMHWYQQKPGQPPKLLIYRASNLDSGIPARFSGVGSRTDFTLTINPVEADDVATYYCQQSNEDPYTFGGGTKLEIE

SEQ ID NO: 39 - protein, 119 aa, Artificial Sequence
  VH sequence - 2B11
DVQLQESGPGLVKPSQSLSLTCSVTGYSITSGYYWNWIRQFPGNKLEWMGHIANDGSNYYNPFLKHRVSITRDTSKNQFFLKLNSVTIQDTATYYCARGGSYFDYVDYWGQGTTLTVSS

SEQ ID NO: 40 - protein, 107 aa, Artificial Sequence
  VL sequence - 2B11
DIQMTQTTSSLSASLGDRVTINCRASQDISNYLNWYQQKPDGTVKLLIYYTSRLHSGVPSRFSGSGSGTDYSLTITNLEQEDIATYFCQQGNTLPFTFGSGTKLEIK

SEQ ID NO: 41 - protein, 10 aa, Artificial Sequence
  CDR Sequence
GFSLNDYGVH

SEQ ID NO: 42 - protein, 8 aa, Artificial Sequence
  CDR Sequence
GFSLNDYG

SEQ ID NO: 43 - protein, 5 aa, Artificial Sequence
  CDR Sequence
DYGVH

SEQ ID NO: 44 - protein, 7 aa, Artificial Sequence
  CDR Sequence
GFSLNDY

SEQ ID NO: 45 - protein, 6 aa, Artificial Sequence
  CDR Sequence
NDYGVH

SEQ ID NO: 46 - protein, 10 aa, Artificial Sequence
  CDR Sequence
GYTFTDYGVI

SEQ ID NO: 47 - protein, 8 aa, Artificial Sequence
  CDR Sequence
GYTFTDYG

SEQ ID NO: 48 - protein, 5 aa, Artificial Sequence
  CDR Sequence
DYGVI

SEQ ID NO: 49 - protein, 7 aa, Artificial Sequence
  CDR Sequence
GYTFTDY

SEQ ID NO: 50 - protein, 6 aa, Artificial Sequence
  CDR Sequence
TDYGVI

SEQ ID NO: 51 - protein, 10 aa, Artificial Sequence
  CDR Sequence
GYPFTIYGMN

SEQ ID NO: 52 - protein, 8 aa, Artificial Sequence
  CDR Sequence
GYPFTIYG

SEQ ID NO: 53 - protein, 5 aa, Artificial Sequence
  CDR Sequence
IYGMN

SEQ ID NO: 54 - protein, 7 aa, Artificial Sequence
  CDR Sequence
GYPFTIY

SEQ ID NO: 55 - protein, 6 aa, Artificial Sequence
  CDR Sequence
TIYGMN

SEQ ID NO: 56 - protein, 10 aa, Artificial Sequence
  CDR Sequence
GYTFTDYYIN

SEQ ID NO: 57 - protein, 8 aa, Artificial Sequence
  CDR Sequence
GYTFTDYY

SEQ ID NO: 58 - protein, 5 aa, Artificial Sequence
  CDR Sequence
DYYIN

SEQ ID NO: 59 - protein, 6 aa, Artificial Sequence
  CDR Sequence
TDYYIN

SEQ ID NO: 60 - protein, 10 aa, Artificial Sequence
  CDR Sequence
GYTFTDYWIE

SEQ ID NO: 61 - protein, 8 aa, Artificial Sequence
  CDR Sequence
GYTFTDYW

SEQ ID NO: 62 - protein, 5 aa, Artificial Sequence
  CDR Sequence
DYWIE

SEQ ID NO: 63 - protein, 6 aa, Artificial Sequence
  CDR Sequence
TDYWIE

SEQ ID NO: 64 - protein, 10 aa, Artificial Sequence
  CDR Sequence
GFSLSRYSVH

SEQ ID NO: 65 - protein, 8 aa, Artificial Sequence
  CDR Sequence
GFSLSRYS

SEQ ID NO: 66 - protein, 5 aa, Artificial Sequence
  CDR Sequence
RYSVH

SEQ ID NO: 67 - protein, 7 aa, Artificial Sequence
  CDR Sequence
GFSLSRY

SEQ ID NO: 68 - protein, 6 aa, Artificial Sequence
  CDR Sequence
SRYSVH

SEQ ID NO: 69 - protein, 10 aa, Artificial Sequence
  CDR Sequence
GYTFTDYWIH

SEQ ID NO: 70 - protein, 5 aa, Artificial Sequence
  CDR Sequence
DYWIH

SEQ ID NO: 71 - protein, 6 aa, Artificial Sequence
  CDR Sequence
TDYWIH

SEQ ID NO: 72 - protein, 10 aa, Artificial Sequence
  CDR Sequence
GYTFTSYWVN

SEQ ID NO: 73 - protein, 8 aa, Artificial Sequence
  CDR Sequence
GYTFTSYW

SEQ ID NO: 74 - protein, 5 aa, Artificial Sequence
  CDR Sequence
SYWVN

SEQ ID NO: 75 - protein, 7 aa, Artificial Sequence
  CDR Sequence
GYTFTSY

SEQ ID NO: 76 - protein, 6 aa, Artificial Sequence
  CDR Sequence
TSYWVN

SEQ ID NO: 77 - protein, 10 aa, Artificial Sequence
  CDR Sequence
GYTFTTYGMS

SEQ ID NO: 78 - protein, 8 aa, Artificial Sequence
  CDR Sequence
GYTFTTYG

SEQ ID NO: 79 - protein, 5 aa, Artificial Sequence
  CDR Sequence
TYGMS

SEQ ID NO: 80 - protein, 7 aa, Artificial Sequence
  CDR Sequence
GYTFTTY

SEQ ID NO: 81 - protein, 6 aa, Artificial Sequence
  CDR Sequence
TTYGMS

SEQ ID NO: 82 - protein, 10 aa, Artificial Sequence
  CDR Sequence
GYTFTDYSMH

SEQ ID NO: 83 - protein, 8 aa, Artificial Sequence
  CDR Sequence
GYTFTDYS

SEQ ID NO: 84 - protein, 5 aa, Artificial Sequence
  CDR Sequence
DYSMH

SEQ ID NO: 85 - protein, 6 aa, Artificial Sequence
  CDR Sequence
TDYSMH

SEQ ID NO: 86 - protein, 10 aa, Artificial Sequence
  CDR Sequence
GYSFTSYNID

SEQ ID NO: 87 - protein, 8 aa, Artificial Sequence
  CDR Sequence
GYSFTSYN

SEQ ID NO: 88 - protein, 5 aa, Artificial Sequence
  CDR Sequence
SYNID

SEQ ID NO: 89 - protein, 7 aa, Artificial Sequence
  CDR Sequence
GYSFTSY

SEQ ID NO: 90 - protein, 6 aa, Artificial Sequence
  CDR Sequence
TSYNID

SEQ ID NO: 91 - protein, 10 aa, Artificial Sequence
  CDR Sequence
GYTFTSYNIN

SEQ ID NO: 92 - protein, 8 aa, Artificial Sequence
  CDR Sequence
GYTFTSYN

SEQ ID NO: 93 - protein, 5 aa, Artificial Sequence
  CDR Sequence
SYNIN

SEQ ID NO: 94 - protein, 6 aa, Artificial Sequence
  CDR Sequence
TSYNIN

SEQ ID NO: 95 - protein, 10 aa, Artificial Sequence
  CDR Sequence
GFTFTGYNIN

SEQ ID NO: 96 - protein, 8 aa, Artificial Sequence
  CDR Sequence
GFTFTGYN

SEQ ID NO: 97 - protein, 5 aa, Artificial Sequence
  CDR Sequence
GYNIN

SEQ ID NO: 98 - protein, 7 aa, Artificial Sequence
  CDR Sequence
GFTFTGY

SEQ ID NO: 99 - protein, 6 aa, Artificial Sequence
  CDR Sequence
TGYNIN

SEQ ID NO: 100 - protein, 10 aa, Artificial Sequence
  CDR Sequence
GYAFTSYWMN

SEQ ID NO: 101 - protein, 8 aa, Artificial Sequence
  CDR Sequence
GYAFTSYW

SEQ ID NO: 102 - protein, 5 aa, Artificial Sequence
  CDR Sequence
SYWMN

SEQ ID NO: 103 - protein, 7 aa, Artificial Sequence
  CDR Sequence
GYAFTSY

SEQ ID NO: 104 - protein, 6 aa, Artificial Sequence
  CDR Sequence
TSYWMN

SEQ ID NO: 105 - protein, 10 aa, Artificial Sequence
  CDR Sequence
GFTFSDYFMF

SEQ ID NO: 106 - protein, 8 aa, Artificial Sequence
  CDR Sequence
GFTFSDYF

SEQ ID NO: 107 - protein, 5 aa, Artificial Sequence
  CDR Sequence
DYFMF

SEQ ID NO: 108 - protein, 7 aa, Artificial Sequence
  CDR Sequence
GFTFSDY

SEQ ID NO: 109 - protein, 6 aa, Artificial Sequence
  CDR Sequence
SDYFMF

SEQ ID NO: 110 - protein, 10 aa, Artificial Sequence
  CDR Sequence
GYTFANYGLT

SEQ ID NO: 111 - protein, 8 aa, Artificial Sequence
  CDR Sequence
GYTFANYG

SEQ ID NO: 112 - protein, 5 aa, Artificial Sequence
  CDR Sequence
NYGLT

SEQ ID NO: 113 - protein, 7 aa, Artificial Sequence
  CDR Sequence
GYTFANY

SEQ ID NO: 114 - protein, 6 aa, Artificial Sequence
  CDR Sequence
ANYGLT

SEQ ID NO: 115 - protein, 10 aa, Artificial Sequence
  CDR Sequence
GFTFSTYAMS

SEQ ID NO: 116 - protein, 8 aa, Artificial Sequence
  CDR Sequence
GFTFSTYA

SEQ ID NO: 117 - protein, 5 aa, Artificial Sequence
  CDR Sequence
TYAMS

SEQ ID NO: 118 - protein, 7 aa, Artificial Sequence
  CDR Sequence
GFTFSTY

SEQ ID NO: 119 - protein, 6 aa, Artificial Sequence
  CDR Sequence
STYAMS

SEQ ID NO: 120 - protein, 10 aa, Artificial Sequence
  CDR Sequence
GYTFTTYWMH

SEQ ID NO: 121 - protein, 8 aa, Artificial Sequence
  CDR Sequence
GYTFTTYW

SEQ ID NO: 122 - protein, 5 aa, Artificial Sequence
  CDR Sequence
TYWMH

SEQ ID NO: 123 - protein, 6 aa, Artificial Sequence
  CDR Sequence
TTYWMH

SEQ ID NO: 124 - protein, 10 aa, Artificial Sequence
  CDR Sequence peptide
GYTFTSYWMQ

SEQ ID NO: 125 - protein, 5 aa, Artificial Sequence
  CDR Sequence
SYWMQ

SEQ ID NO: 126 - protein, 6 aa, Artificial Sequence
  CDR Sequence
TSYWMQ

SEQ ID NO: 127 - protein, 11 aa, Artificial Sequence
  CDR Sequence
GYSITSGYYWN

SEQ ID NO: 128 - protein, 9 aa, Artificial Sequence
  CDR Sequence
GYSITSGYY

SEQ ID NO: 129 - protein, 6 aa, Artificial Sequence
  CDR Sequence
SGYYWN

SEQ ID NO: 130 - protein, 8 aa, Artificial Sequence
  CDR Sequence
GYSITSGY

SEQ ID NO: 131 - protein, 7 aa, Artificial Sequence
  CDR Sequence
TSGYYWN

SEQ ID NO: 132 - protein, 16 aa, Artificial Sequence
  CDR Sequence
VIWSGGRTDYNAAFIS

SEQ ID NO: 133 - protein, 7 aa, Artificial Sequence
  CDR Sequence
IWSGGRT

SEQ ID NO: 134 - protein, 3 aa, Artificial Sequence
  CDR Sequence
SGG

SEQ ID NO: 135 - protein, 12 aa, Artificial Sequence
  CDR Sequence
WLGVIWSGGRTD

SEQ ID NO: 136 - protein, 9 aa, Artificial Sequence
  CDR Sequence
VIWSGGRTD

SEQ ID NO: 137 - protein, 17 aa, Artificial Sequence
  CDR Sequence
WINTYTGEPTYADDLKG

SEQ ID NO: 138 - protein, 8 aa, Artificial Sequence
  CDR Sequence
INTYTGEP

SEQ ID NO: 139 - protein, 4 aa, Artificial Sequence
  CDR Sequence
TYTG

SEQ ID NO: 140 - protein, 13 aa, Artificial Sequence
  CDR Sequence
WMGWINTYTGEPT

SEQ ID NO: 141 - protein, 10 aa, Artificial Sequence
  CDR Sequence
WINTYTGEPT

SEQ ID NO: 142 - protein, 17 aa, Artificial Sequence
  CDR Sequence
WINTYSGVPTYADDFKG

SEQ ID NO: 143 - protein, 8 aa, Artificial Sequence
  CDR Sequence
INTYSGVP

SEQ ID NO: 144 - protein, 4 aa, Artificial Sequence
  CDR Sequence
TYSG

SEQ ID NO: 145 - protein, 13 aa, Artificial Sequence
  CDR Sequence
WMGWINTYSGVPT

SEQ ID NO: 146 - protein, 10 aa, Artificial Sequence
  CDR Sequence
WINTYSGVPT

SEQ ID NO: 147 - protein, 17 aa, Artificial Sequence
  CDR Sequence
RIYPGNGNTYHNEKFKG

SEQ ID NO: 148 - protein, 8 aa, Artificial Sequence
  CDR Sequence
IYPGNGNT

SEQ ID NO: 149 - protein, 4 aa, Artificial Sequence
  CDR Sequence
PGNG

SEQ ID NO: 150 - protein, 13 aa, Artificial Sequence
  CDR Sequence
WIARIYPGNGNTY

SEQ ID NO: 151 - protein, 10 aa, Artificial Sequence
  CDR Sequence
RIYPGNGNTY

SEQ ID NO: 152 - protein, 17 aa, Artificial Sequence
  CDR Sequence
EILLGSDSIHFNEKFKG

SEQ ID NO: 153 - protein, 8 aa, Artificial Sequence
  CDR Sequence
ILLGSDSI

SEQ ID NO: 154 - protein, 4 aa, Artificial Sequence
  CDR Sequence
LGSD

SEQ ID NO: 155 - protein, 13 aa, Artificial Sequence
  CDR Sequence
WIGEILLGSDSIH

SEQ ID NO: 156 - protein, 10 aa, Artificial Sequence
  CDR Sequence
EILLGSDSIH

SEQ ID NO: 157 - protein, 16 aa, Artificial Sequence
  CDR Sequence
MIWGFGSTDYNSALKS

SEQ ID NO: 158 - protein, 3 aa, Artificial Sequence
  CDR Sequence
GFG

SEQ ID NO: 159 - protein, 12 aa, Artificial Sequence
  CDR Sequence
WLGMIWGFGSTD

SEQ ID NO: 160 - protein, 9 aa, Artificial Sequence
  CDR Sequence
MIWGFGSTD

SEQ ID NO: 161 - protein, 17 aa, Artificial Sequence
  CDR Sequence
YINPNSNYAEYNQKFKV

SEQ ID NO: 162 - protein, 8 aa, Artificial Sequence
  CDR Sequence
INPNSNYA

SEQ ID NO: 163 - protein, 4 aa, Artificial Sequence
  CDR Sequence
PNSN

SEQ ID NO: 164 - protein, 13 aa, Artificial Sequence
  CDR Sequence
WIGYINPNSNYAE

SEQ ID NO: 165 - protein, 10 aa, Artificial Sequence
  CDR Sequence
YINPNSNYAE

SEQ ID NO: 166 - protein, 17 aa, Artificial Sequence
  CDR Sequence
RIYPGDGDTNYNGKFKG

SEQ ID NO: 167 - protein, 8 aa, Artificial Sequence
  CDR Sequence
IYPGDGDT

SEQ ID NO: 168 - protein, 4 aa, Artificial Sequence
  CDR Sequence
PGDG

SEQ ID NO: 169 - protein, 13 aa, Artificial Sequence
  CDR Sequence
WIGRIYPGDGDTN

SEQ ID NO: 170 - protein, 10 aa, Artificial Sequence
  CDR Sequence
RIYPGDGDTN

SEQ ID NO: 171 - protein, 17 aa, Artificial Sequence
  CDR Sequence
WINTYSGVPTFVDDFRG

SEQ ID NO: 172 - protein, 17 aa, Artificial Sequence
  CDR Sequence
WINTETGEPTYADDFKG

SEQ ID NO: 173 - protein, 8 aa, Artificial Sequence
  CDR Sequence
INTETGEP

SEQ ID NO: 174 - protein, 4 aa, Artificial Sequence
  CDR Sequence
TETG

SEQ ID NO: 175 - protein, 13 aa, Artificial Sequence
  CDR Sequence
WMGWINTETGEPT

SEQ ID NO: 176 - protein, 10 aa, Artificial Sequence
  CDR Sequence
WINTETGEPT

SEQ ID NO: 177 - protein, 9 aa, Artificial Sequence
  CDR Sequence
WIFPGDGST

SEQ ID NO: 178 - protein, 8 aa, Artificial Sequence
  CDR Sequence
IFPGDGST

SEQ ID NO: 179 - protein, 17 aa, Artificial Sequence
  CDR Sequence
WIFPGDGSTKYNEKFKG

SEQ ID NO: 180 - protein, 13 aa, Artificial Sequence
  CDR Sequence
WIGWIFPGDGSTK

SEQ ID NO: 181 - protein, 10 aa, Artificial Sequence
  CDR Sequence
WIFPGDGSTK

SEQ ID NO: 182 - protein, 17 aa, Artificial Sequence
  CDR Sequence
WIFPGDDSIKYNENFRG

SEQ ID NO: 183 - protein, 8 aa, Artificial Sequence
  CDR Sequence
IFPGDDSI

SEQ ID NO: 184 - protein, 4 aa, Artificial Sequence
  CDR Sequence
PGDD

SEQ ID NO: 185 - protein, 13 aa, Artificial Sequence
  CDR Sequence
WIGWIFPGDDSIK

SEQ ID NO: 186 - protein, 10 aa, Artificial Sequence
  CDR Sequence
WIFPGDDSIK

SEQ ID NO: 187 - protein, 17 aa, Artificial Sequence
  CDR Sequence
WIFPGDDNAKYNEKFKG

SEQ ID NO: 188 - protein, 8 aa, Artificial Sequence
  CDR Sequence
IFPGDDNA

SEQ ID NO: 189 - protein, 13 aa, Artificial Sequence
  CDR Sequence
WIGWIFPGDDNAK

SEQ ID NO: 190 - protein, 10 aa, Artificial Sequence
  CDR Sequence
WIFPGDDNAK

SEQ ID NO: 191 - protein, 17 aa, Artificial Sequence
  CDR Sequence
YISNDGDSTYYPDTVQG

SEQ ID NO: 192 - protein, 8 aa, Artificial Sequence
  CDR Sequence
ISNDGDST

SEQ ID NO: 193 - protein, 4 aa, Artificial Sequence
  CDR Sequence
NDGD

SEQ ID NO: 194 - protein, 13 aa, Artificial Sequence
  CDR Sequence
WVAYISNDGDSTY

SEQ ID NO: 195 - protein, 10 aa, Artificial Sequence
  CDR Sequence
YISNDGDSTY

SEQ ID NO: 196 - protein, 17 aa, Artificial Sequence
  CDR Sequence
EIYPGSGHTHYNEDFKG

SEQ ID NO: 197 - protein, 8 aa, Artificial Sequence
  CDR Sequence
IYPGSGHT

SEQ ID NO: 198 - protein, 4 aa, Artificial Sequence
  CDR Sequence
PGSG

SEQ ID NO: 199 - protein, 13 aa, Artificial Sequence
  CDR Sequence
WIGEIYPGSGHTH

SEQ ID NO: 200 - protein, 10 aa, Artificial Sequence
  CDR Sequence
EIYPGSGHTH

SEQ ID NO: 201 - protein, 16 aa, Artificial Sequence
  CDR Sequence
SITSGGTTYYTDSVKG

SEQ ID NO: 202 - protein, 7 aa, Artificial Sequence
  CDR Sequence
ITSGGTT

SEQ ID NO: 203 - protein, 12 aa, Artificial Sequence
  CDR Sequence
WVASITSGGTTY

SEQ ID NO: 204 - protein, 9 aa, Artificial Sequence
  CDR Sequence
SITSGGTTY

SEQ ID NO: 205 - protein, 17 aa, Artificial Sequence
  CDR Sequence
MIHPNSGSSNYNEKFKN

SEQ ID NO: 206 - protein, 8 aa, Artificial Sequence
  CDR Sequence
IHPNSGSS

SEQ ID NO: 207 - protein, 4 aa, Artificial Sequence
  CDR Sequence
PNSG

SEQ ID NO: 208 - protein, 13 aa, Artificial Sequence
  CDR Sequence
WIGMIHPNSGSSN

SEQ ID NO: 209 - protein, 10 aa, Artificial Sequence
  CDR Sequence
MIHPNSGSSN

SEQ ID NO: 210 - protein, 17 aa, Artificial Sequence
  CDR Sequence
EIDPSDSYTNYNQKFKG

SEQ ID NO: 211 - protein, 8 aa, Artificial Sequence
  CDR Sequence
IDPSDSYT

SEQ ID NO: 212 - protein, 4 aa, Artificial Sequence
  CDR Sequence
PSDS

SEQ ID NO: 213 - protein, 13 aa, Artificial Sequence
  CDR Sequence
WIGEIDPSDSYTN

SEQ ID NO: 214 - protein, 10 aa, Artificial Sequence
  CDR Sequence
EIDPSDSYTN

SEQ ID NO: 215 - protein, 16 aa, Artificial Sequence
  CDR Sequence
HIANDGSNYYNPFLKH

SEQ ID NO: 216 - protein, 7 aa, Artificial Sequence
  CDR Sequence
IANDGSN

SEQ ID NO: 217 - protein, 3 aa, Artificial Sequence
  CDR Sequence
NDG

SEQ ID NO: 218 - protein, 12 aa, Artificial Sequence
  CDR Sequence
WMGHIANDGSNY

SEQ ID NO: 219 - protein, 9 aa, Artificial Sequence
  CDR Sequence
HIANDGSNY

SEQ ID NO: 220 - protein, 7 aa, Artificial Sequence
  CDR Sequence
IWGFGST

SEQ ID NO: 221 - protein, 13 aa, Artificial Sequence
  CDR Sequence
WALYFLYGGSMDY

SEQ ID NO: 222 - protein, 15 aa, Artificial Sequence
  CDR Sequence
ARWALYFLYGGSMDY

SEQ ID NO: 223 - protein, 11 aa, Artificial Sequence
  CDR Sequence
ALYFLYGGSMD

SEQ ID NO: 224 - protein, 14 aa, Artificial Sequence
  CDR Sequence
ARWALYFLYGGSMD

SEQ ID NO: 225 - protein, 9 aa, Artificial Sequence
  CDR Sequence
RYGPEDIDY

SEQ ID NO: 226 - protein, 11 aa, Artificial Sequence
  CDR Sequence
ARRYGPEDIDY

SEQ ID NO: 227 - protein, 7 aa, Artificial Sequence
  CDR Sequence
YGPEDID

SEQ ID NO: 228 - protein, 10 aa, Artificial Sequence
  CDR Sequence
ARRYGPEDID

SEQ ID NO: 229 - protein, 5 aa, Artificial Sequence
  CDR Sequence
ATGNY

SEQ ID NO: 230 - protein, 7 aa, Artificial Sequence
  CDR Sequence
ASATGNY

SEQ ID NO: 231 - protein, 3 aa, Artificial Sequence
  CDR Sequence
TGN

SEQ ID NO: 232 - protein, 6 aa, Artificial Sequence
  CDR Sequence
ASATGN

SEQ ID NO: 233 - protein, 13 aa, Artificial Sequence
  CDR Sequence
EGLYYDYDRYFDY

SEQ ID NO: 234 - protein, 15 aa, Artificial Sequence
  CDR Sequence
AREGLYYDYDRYFDY

SEQ ID NO: 235 - protein, 11 aa, Artificial Sequence
  CDR Sequence
GLYYDYDRYFD

SEQ ID NO: 236 - protein, 14 aa, Artificial Sequence
  CDR Sequence
AREGLYYDYDRYFD

SEQ ID NO: 237 - protein, 9 aa, Artificial Sequence
  CDR Sequence
QDWNWYFDV

SEQ ID NO: 238 - protein, 11 aa, Artificial Sequence
  CDR Sequence
VRQDWNWYFDV

SEQ ID NO: 239 - protein, 7 aa, Artificial Sequence
  CDR Sequence
DWNWYFD

SEQ ID NO: 240 - protein, 10 aa, Artificial Sequence
  CDR Sequence
VRQDWNWYFD

SEQ ID NO: 241 - protein, 8 aa, Artificial Sequence
  CDR Sequence
IHTTAGSY

SEQ ID NO: 242 - protein, 10 aa, Artificial Sequence
  CDR Sequence
ARIHTTAGSY

SEQ ID NO: 243 - protein, 6 aa, Artificial Sequence
  CDR Sequence
HTTAGS

SEQ ID NO: 244 - protein, 9 aa, Artificial Sequence
  CDR Sequence
ARIHTTAGS

SEQ ID NO: 245 - protein, 9 aa, Artificial Sequence
  CDR Sequence
FDWNWYFHV

SEQ ID NO: 246 - protein, 11 aa, Artificial Sequence
  CDR Sequence
ARFDWNWYFHV

SEQ ID NO: 247 - protein, 7 aa, Artificial Sequence
  CDR Sequence
DWNWYFH

SEQ ID NO: 248 - protein, 10 aa, Artificial Sequence
  CDR Sequence
ARFDWNWYFH

SEQ ID NO: 249 - protein, 16 aa, Artificial Sequence
  CDR Sequence
AYLLRLRRTGYYAMDY

SEQ ID NO: 250 - protein, 18 aa, Artificial Sequence
  CDR Sequence
ARAYLLRLRRTGYYAMDY

SEQ ID NO: 251 - protein, 14 aa, Artificial Sequence
  CDR Sequence
YLLRLRRTGYYAMD

SEQ ID NO: 252 - protein, 17 aa, Artificial Sequence
  CDR Sequence
ARAYLLRLRRTGYYAMD

SEQ ID NO: 253 - protein, 12 aa, Artificial Sequence
  CDR Sequence
RSSYYPYWYFDV

SEQ ID NO: 254 - protein, 14 aa, Artificial Sequence
  CDR Sequence
ARRSSYYPYWYFDV

SEQ ID NO: 255 - protein, 10 aa, Artificial Sequence
  CDR Sequence
SSYYPYWYFD

SEQ ID NO: 256 - protein, 13 aa, Artificial Sequence
  CDR Sequence
ARRSSYYPYWYFD

SEQ ID NO: 257 - protein, 5 aa, Artificial Sequence
  CDR Sequence
GTLNY

SEQ ID NO: 258 - protein, 7 aa, Artificial Sequence
  CDR Sequence
VKGTLNY

SEQ ID NO: 259 - protein, 3 aa, Artificial Sequence
  CDR Sequence
TLN

SEQ ID NO: 260 - protein, 6 aa, Artificial Sequence
  CDR Sequence
VKGTLN

SEQ ID NO: 261 - protein, 11 aa, Artificial Sequence
  CDR Sequence
SGIYYGSHFVY

SEQ ID NO: 262 - protein, 13 aa, Artificial Sequence
  CDR Sequence
ARSGIYYGSHFVY

SEQ ID NO: 263 - protein, 9 aa, Artificial Sequence
  CDR Sequence
GIYYGSHFV

SEQ ID NO: 264 - protein, 12 aa, Artificial Sequence
  CDR Sequence
ARSGIYYGSHFV

SEQ ID NO: 265 - protein, 11 aa, Artificial Sequence
  CDR Sequence
SGIFYGNNFAY

SEQ ID NO: 266 - protein, 13 aa, Artificial Sequence
  CDR Sequence
ARSGIFYGNNFAY

SEQ ID NO: 267 - protein, 9 aa, Artificial Sequence
  CDR Sequence
GIFYGNNFA

SEQ ID NO: 268 - protein, 12 aa, Artificial Sequence
  CDR Sequence
ARSGIFYGNNFA

SEQ ID NO: 269 - protein, 10 aa, Artificial Sequence
  CDR Sequence
TPVLSNYFDY

SEQ ID NO: 270 - protein, 12 aa, Artificial Sequence
  CDR Sequence
ARTPVLSNYFDY

SEQ ID NO: 271 - protein, 8 aa, Artificial Sequence
  CDR Sequence
PVLSNYFD

SEQ ID NO: 272 - protein, 11 aa, Artificial Sequence
  CDR Sequence
ARTPVLSNYFD

SEQ ID NO: 273 - protein, 9 aa, Artificial Sequence
  CDR Sequence
QGAQATLDY

SEQ ID NO: 274 - protein, 11 aa, Artificial Sequence
  CDR Sequence
TRQGAQATLDY

SEQ ID NO: 275 - protein, 7 aa, Artificial Sequence
  CDR Sequence
GAQATLD

SEQ ID NO: 276 - protein, 10 aa, Artificial Sequence
  CDR Sequence
TRQGAQATLD

SEQ ID NO: 277 - protein, 13 aa, Artificial Sequence
  CDR Sequence
RIQLLLPVGGFVY

SEQ ID NO: 278 - protein, 15 aa, Artificial Sequence
  CDR Sequence
ARRIQLLLPVGGFVY

SEQ ID NO: 279 - protein, 11 aa, Artificial Sequence
  CDR Sequence
IQLLLPVGGFV

SEQ ID NO: 280 - protein, 14 aa, Artificial Sequence
  CDR Sequence
ARRIQLLLPVGGFV

SEQ ID NO: 281 - protein, 11 aa, Artificial Sequence
  CDR Sequence
DGNFYYYGMDY

SEQ ID NO: 282 - protein, 13 aa, Artificial Sequence
  CDR Sequence
ARDGNFYYYGMDY

SEQ ID NO: 283 - protein, 9 aa, Artificial Sequence
  CDR Sequence
GNFYYYGMD

SEQ ID NO: 284 - protein, 12 aa, Artificial Sequence
  CDR Sequence
ARDGNFYYYGMD

SEQ ID NO: 285 - protein, 11 aa, Artificial Sequence
  CDR Sequence
SDYGFIPYFDY

SEQ ID NO: 286 - protein, 13 aa, Artificial Sequence
  CDR Sequence
ARSDYGFIPYFDY

SEQ ID NO: 287 - protein, 9 aa, Artificial Sequence
  CDR Sequence
DYGFIPYFD

SEQ ID NO: 288 - protein, 12 aa, Artificial Sequence
  CDR Sequence
ARSDYGFIPYFD

SEQ ID NO: 289 - protein, 11 aa, Artificial Sequence
  CDR Sequence
PLDRSAYYFDY

SEQ ID NO: 290 - protein, 13 aa, Artificial Sequence
  CDR Sequence
ARPLDRSAYYFDY

SEQ ID NO: 291 - protein, 9 aa, Artificial Sequence
  CDR Sequence
LDRSAYYFD

SEQ ID NO: 292 - protein, 12 aa, Artificial Sequence
  CDR Sequence
ARPLDRSAYYFD

SEQ ID NO: 293 - protein, 10 aa, Artificial Sequence
  CDR Sequence
GGSYFDYVDY

SEQ ID NO: 294 - protein, 12 aa, Artificial Sequence
  CDR Sequence
ARGGSYFDYVDY

SEQ ID NO: 295 - protein, 8 aa, Artificial Sequence
  CDR Sequence
GSYFDYVD

SEQ ID NO: 296 - protein, 11 aa, Artificial Sequence
  CDR Sequence
ARGGSYFDYVD

SEQ ID NO: 297 - protein, 16 aa, Artificial Sequence
  CDR Sequence
RSSQSLVHSSGITYLH

SEQ ID NO: 298 - protein, 11 aa, Artificial Sequence
  CDR Sequence
QSLVHSSGITY

SEQ ID NO: 299 - protein, 12 aa, Artificial Sequence
  CDR Sequence
SQSLVHSSGITY

SEQ ID NO: 300 - protein, 12 aa, Artificial Sequence
  CDR Sequence
VHSSGITYLHWY

SEQ ID NO: 301 - protein, 15 aa, Artificial Sequence
  CDR Sequence
RASESVDNYGISFMS

SEQ ID NO: 302 - protein, 10 aa, Artificial Sequence
  CDR Sequence
ESVDNYGISF

SEQ ID NO: 303 - protein, 11 aa, Artificial Sequence
  CDR Sequence
SESVDNYGISF

SEQ ID NO: 304 - protein, 11 aa, Artificial Sequence
  CDR Sequence
DNYGISFMSWF

SEQ ID NO: 305 - protein, 11 aa, Artificial Sequence
  CDR Sequence
RASQDIGSSLN

SEQ ID NO: 306 - protein, 6 aa, Artificial Sequence
  CDR Sequence
QDIGSS

SEQ ID NO: 307 - protein, 7 aa, Artificial Sequence
  CDR Sequence
SQDIGSS

SEQ ID NO: 308 - protein, 7 aa, Artificial Sequence
  CDR Sequence
GSSLNWL

SEQ ID NO: 309 - protein, 15 aa, Artificial Sequence
  CDR Sequence
RASESVDTYGNSFMH

SEQ ID NO: 310 - protein, 10 aa, Artificial Sequence
  CDR Sequence
ESVDTYGNSF

SEQ ID NO: 311 - protein, 11 aa, Artificial Sequence
  CDR Sequence
SESVDTYGNSF

SEQ ID NO: 312 - protein, 11 aa, Artificial Sequence
  CDR Sequence
DTYGNSFMHWY

SEQ ID NO: 313 - protein, 16 aa, Artificial Sequence
  CDR Sequence
KSSQSLLDFDGKTYLN

SEQ ID NO: 314 - protein, 11 aa, Artificial Sequence
  CDR Sequence
QSLLDFDGKTY

SEQ ID NO: 315 - protein, 12 aa, Artificial Sequence
  CDR Sequence
SQSLLDFDGKTY

SEQ ID NO: 316 - protein, 12 aa, Artificial Sequence
  CDR Sequence
LDFDGKTYLNWY

SEQ ID NO: 317 - protein, 11 aa, Artificial Sequence
  CDR Sequence
KASQNVGTNVA

SEQ ID NO: 318 - protein, 6 aa, Artificial Sequence
  CDR Sequence
QNVGTN

SEQ ID NO: 319 - protein, 7 aa, Artificial Sequence
  CDR Sequence
SQNVGTN

SEQ ID NO: 320 - protein, 7 aa, Artificial Sequence
  CDR Sequence
GTNVAWY

SEQ ID NO: 321 - protein, 16 aa, Artificial Sequence
  CDR Sequence
KSSQSLSDSDGKTYLN

SEQ ID NO: 322 - protein, 11 aa, Artificial Sequence
  CDR Sequence
QSLSDSDGKTY

SEQ ID NO: 323 - protein, 12 aa, Artificial Sequence
  CDR Sequence
SQSLSDSDGKTY

SEQ ID NO: 324 - protein, 12 aa, Artificial Sequence
  CDR Sequence
SDSDGKTYLNWL

SEQ ID NO: 325 - protein, 16 aa, Artificial Sequence
  CDR Sequence
KSTKSLLNSDEFTYLD

SEQ ID NO: 326 - protein, 11 aa, Artificial Sequence
  CDR Sequence
KSLLNSDEFTY

SEQ ID NO: 327 - protein, 12 aa, Artificial Sequence
  CDR Sequence
TKSLLNSDEFTY

SEQ ID NO: 328 - protein, 12 aa, Artificial Sequence
  CDR Sequence
LNSDEFTYLDWY

SEQ ID NO: 329 - protein, 11 aa, Artificial Sequence
  CDR Sequence
RPSENIYSYLT

SEQ ID NO: 330 - protein, 6 aa, Artificial Sequence
  CDR Sequence
ENIYSY

SEQ ID NO: 331 - protein, 7 aa, Artificial Sequence
  CDR Sequence
SENIYSY

SEQ ID NO: 332 - protein, 7 aa, Artificial Sequence
  CDR Sequence
YSYLTWF

SEQ ID NO: 333 - protein, 11 aa, Artificial Sequence
  CDR Sequence
KASQDIKSYLN

SEQ ID NO: 334 - protein, 6 aa, Artificial Sequence
  CDR Sequence
QDIKSY

SEQ ID NO: 335 - protein, 7 aa, Artificial Sequence
  CDR Sequence
SQDIKSY

SEQ ID NO: 336 - protein, 7 aa, Artificial Sequence
  CDR Sequence
KSYLNWF

SEQ ID NO: 337 - protein, 16 aa, Artificial Sequence
  CDR Sequence
RSSQSLLDSDGKTYLN

SEQ ID NO: 338 - protein, 11 aa, Artificial Sequence
  CDR Sequence
QSLLDSDGKTY

SEQ ID NO: 339 - protein, 12 aa, Artificial Sequence
  CDR Sequence
SQSLLDSDGKTY

SEQ ID NO: 340 - protein, 12 aa, Artificial Sequence
  CDR Sequence
LDSDGKTYLNWL

SEQ ID NO: 341 - protein, 16 aa, Artificial Sequence
  CDR Sequence
KSSQSLLDGDGETYLS

SEQ ID NO: 342 - protein, 11 aa, Artificial Sequence
  CDR Sequence
QSLLDGDGETY

SEQ ID NO: 343 - protein, 12 aa, Artificial Sequence
  CDR Sequence
SQSLLDGDGETY

SEQ ID NO: 344 - protein, 12 aa, Artificial Sequence
  CDR Sequence
LDGDGETYLSWL

SEQ ID NO: 345 - protein, 11 aa, Artificial Sequence
  CDR Sequence
KASQDISKYIS

SEQ ID NO: 346 - protein, 6 aa, Artificial Sequence
  CDR Sequence
QDISKY

SEQ ID NO: 347 - protein, 7 aa, Artificial Sequence
  CDR Sequence
SQDISKY

SEQ ID NO: 348 - protein, 7 aa, Artificial Sequence
  CDR Sequence
SKYISWY

SEQ ID NO: 349 - protein, 10 aa, Artificial Sequence
  CDR Sequence
SASSSVFYMH

SEQ ID NO: 350 - protein, 5 aa, Artificial Sequence
  CDR Sequence
SSVFY

SEQ ID NO: 351 - protein, 6 aa, Artificial Sequence
  CDR Sequence
SSSVFY

SEQ ID NO: 352 - protein, 6 aa, Artificial Sequence
  CDR Sequence
FYMHWY

SEQ ID NO: 353 - protein, 11 aa, Artificial Sequence
  CDR Sequence
RASQSISNNLH

SEQ ID NO: 354 - protein, 6 aa, Artificial Sequence
  CDR Sequence
QSISNN

SEQ ID NO: 355 - protein, 7 aa, Artificial Sequence
  CDR Sequence
SQSISNN

SEQ ID NO: 356 - protein, 7 aa, Artificial Sequence
  CDR Sequence
SNNLHWY

SEQ ID NO: 357 - protein, 11 aa, Artificial Sequence
  CDR Sequence
KASQNVGTAVA

SEQ ID NO: 358 - protein, 6 aa, Artificial Sequence
  CDR Sequence
QNVGTA

SEQ ID NO: 359 - protein, 7 aa, Artificial Sequence
  CDR Sequence
SQNVGTA

SEQ ID NO: 360 - protein, 7 aa, Artificial Sequence
  CDR Sequence
GTAVAWY

SEQ ID NO: 361 - protein, 11 aa, Artificial Sequence
  CDR Sequence
RASQSIGTSIH

SEQ ID NO: 362 - protein, 6 aa, Artificial Sequence
  CDR Sequence
QSIGTS

SEQ ID NO: 363 - protein, 7 aa, Artificial Sequence
  CDR Sequence
SQSIGTS

SEQ ID NO: 364 - protein, 7 aa, Artificial Sequence
  CDR Sequence
GTSIHWY

SEQ ID NO: 365 - protein, 15 aa, Artificial Sequence
  CDR Sequence
RASESVDFSGNSFMH

SEQ ID NO: 366 - protein, 10 aa, Artificial Sequence
  CDR Sequence
ESVDFSGNSF

SEQ ID NO: 367 - protein, 11 aa, Artificial Sequence
  CDR Sequence
SESVDFSGNSF

SEQ ID NO: 368 - protein, 11 aa, Artificial Sequence
  CDR Sequence
DFSGNSFMHWY

SEQ ID NO: 369 - protein, 11 aa, Artificial Sequence
  CDR Sequence
RASQDISNYLN

SEQ ID NO: 370 - protein, 6 aa, Artificial Sequence
  CDR Sequence
QDISNY

SEQ ID NO: 371 - protein, 7 aa, Artificial Sequence
  CDR Sequence
SQDISNY

SEQ ID NO: 372 - protein, 7 aa, Artificial Sequence
  CDR Sequence
SNYLNWY

SEQ ID NO: 373 - protein, 7 aa, Artificial Sequence
  CDR Sequence
KLSNRFS

SEQ ID NO: 374 - protein, 3 aa, Artificial Sequence
  CDR Sequence
KLS

SEQ ID NO: 375 - protein, 10 aa, Artificial Sequence
  CDR Sequence
LLIYKLSNRF

SEQ ID NO: 376 - protein, 7 aa, Artificial Sequence
  CDR Sequence
AASHQGS

SEQ ID NO: 377 - protein, 3 aa, Artificial Sequence
  CDR Sequence
AAS

SEQ ID NO: 378 - protein, 10 aa, Artificial Sequence
  CDR Sequence
LLIYAASHQG

SEQ ID NO: 379 - protein, 7 aa, Artificial Sequence
  CDR Sequence
ATSSLDS

SEQ ID NO: 380 - protein, 3 aa, Artificial Sequence
  CDR Sequence
ATS

SEQ ID NO: 381 - protein, 10 aa, Artificial Sequence
  CDR Sequence
RLIYATSSLD

SEQ ID NO: 382 - protein, 7 aa, Artificial Sequence
  CDR Sequence
LASNLES

SEQ ID NO: 383 - protein, 3 aa, Artificial Sequence
  CDR Sequence
LAS

SEQ ID NO: 384 - protein, 10 aa, Artificial Sequence
  CDR Sequence
LLIYLASNLE

SEQ ID NO: 385 - protein, 7 aa, Artificial Sequence
  CDR Sequence
LVSKLDS

SEQ ID NO: 386 - protein, 3 aa, Artificial Sequence
  CDR Sequence
LVS

SEQ ID NO: 387 - protein, 10 aa, Artificial Sequence
  CDR Sequence
RLFYLVSKLD

SEQ ID NO: 388 - protein, 7 aa, Artificial Sequence
  CDR Sequence
STSYRYS

SEQ ID NO: 389 - protein, 3 aa, Artificial Sequence
  CDR Sequence
STS

SEQ ID NO: 390 - protein, 10 aa, Artificial Sequence
  CDR Sequence
ALVYSTSYRY

SEQ ID NO: 391 - protein, 7 aa, Artificial Sequence
  CDR Sequence
LVSRLGS

SEQ ID NO: 392 - protein, 10 aa, Artificial Sequence
  CDR Sequence
RLIYLVSRLG

SEQ ID NO: 393 - protein, 7 aa, Artificial Sequence
  CDR Sequence
LVSNRFS

SEQ ID NO: 394 - protein, 10 aa, Artificial Sequence
  CDR Sequence
LLIFLVSNRF

SEQ ID NO: 395 - protein, 7 aa, Artificial Sequence
  CDR Sequence
NAQTLAE

SEQ ID NO: 396 - protein, 3 aa, Artificial Sequence
  CDR Sequence
NAQ

SEQ ID NO: 397 - protein, 10 aa, Artificial Sequence
  CDR Sequence
LLVYNAQTLA

SEQ ID NO: 398 - protein, 7 aa, Artificial Sequence
  CDR Sequence
RTKRLVD

SEQ ID NO: 399 - protein, 3 aa, Artificial Sequence
  CDR Sequence
RTK

SEQ ID NO: 400 - protein, 10 aa, Artificial Sequence
  CDR Sequence
TLIYRTKRLV

SEQ ID NO: 401 - protein, 7 aa, Artificial Sequence
  CDR Sequence
LVSKVDS

SEQ ID NO: 402 - protein, 10 aa, Artificial Sequence
  CDR Sequence
RLIYLVSKVD

SEQ ID NO: 403 - protein, 10 aa, Artificial Sequence
  CDR Sequence
RLIYLVSKLD

SEQ ID NO: 404 - protein, 7 aa, Artificial Sequence
  CDR Sequence
YTSTLQP

SEQ ID NO: 405 - protein, 3 aa, Artificial Sequence
  CDR Sequence
YTS

SEQ ID NO: 406 - protein, 10 aa, Artificial Sequence
  CDR Sequence
LLIHYTSTLQ

SEQ ID NO: 407 - protein, 10 aa, Artificial Sequence
  CDR Sequence
LLIYLVSNRF

SEQ ID NO: 408 - protein, 7 aa, Artificial Sequence
  CDR Sequence
STSNLAS

SEQ ID NO: 409 - protein, 10 aa, Artificial Sequence
  CDR Sequence
LLIYSTSNLA

SEQ ID NO: 410 - protein, 7 aa, Artificial Sequence
  CDR Sequence
YASQSIS

SEQ ID NO: 411 - protein, 3 aa, Artificial Sequence
  CDR Sequence
YAS

SEQ ID NO: 412 - protein, 10 aa, Artificial Sequence
  CDR Sequence
LLIKYASQSI

SEQ ID NO: 413 - protein, 7 aa, Artificial Sequence
  CDR Sequence
SASNRFT

SEQ ID NO: 414 - protein, 3 aa, Artificial Sequence
  CDR Sequence
SAS

SEQ ID NO: 415 - protein, 10 aa, Artificial Sequence
  CDR Sequence
ILIYSASNRF

SEQ ID NO: 416 - protein, 7 aa, Artificial Sequence
  CDR Sequence
YASESIS

SEQ ID NO: 417 - protein, 10 aa, Artificial Sequence
  CDR Sequence
LLIKYASESI

SEQ ID NO: 418 - protein, 7 aa, Artificial Sequence
  CDR Sequence
RASNLDS

SEQ ID NO: 419 - protein, 3 aa, Artificial Sequence
  CDR Sequence
RAS

SEQ ID NO: 420 - protein, 10 aa, Artificial Sequence
  CDR Sequence
LLIYRASNLD

SEQ ID NO: 421 - protein, 7 aa, Artificial Sequence
  CDR Sequence
YTSRLHS

SEQ ID NO: 422 - protein, 10 aa, Artificial Sequence
  CDR Sequence
LLIYYTSRLH

SEQ ID NO: 423 - protein, 10 aa, Artificial Sequence
  CDR Sequence
SQSTHVPPWT

SEQ ID NO: 424 - protein, 7 aa, Artificial Sequence
  CDR Sequence
STHVPPW

SEQ ID NO: 425 - protein, 9 aa, Artificial Sequence
  CDR Sequence
SQSTHVPPW

SEQ ID NO: 426 - protein, 9 aa, Artificial Sequence
  CDR Sequence
LQSKEVPWT

SEQ ID NO: 427 - protein, 6 aa, Artificial Sequence
  CDR Sequence
SKEVPW

SEQ ID NO: 428 - protein, 8 aa, Artificial Sequence
  CDR Sequence
LQSKEVPW

SEQ ID NO: 429 - protein, 9 aa, Artificial Sequence
  CDR Sequence
LQYASSPYT

SEQ ID NO: 430 - protein, 6 aa, Artificial Sequence
  CDR Sequence
YASSPY

SEQ ID NO: 431 - protein, 8 aa, Artificial Sequence
  CDR Sequence
LQYASSPY

SEQ ID NO: 432 - protein, 9 aa, Artificial Sequence
  CDR Sequence
HQNNEDPPA

SEQ ID NO: 433 - protein, 6 aa, Artificial Sequence
  CDR Sequence
NNEDPP

SEQ ID NO: 434 - protein, 8 aa, Artificial Sequence
  CDR Sequence
HQNNEDPP

SEQ ID NO: 435 - protein, 9 aa, Artificial Sequence
  CDR Sequence
WQGTHFPRT

SEQ ID NO: 436 - protein, 6 aa, Artificial Sequence
  CDR Sequence
GTHFPR

SEQ ID NO: 437 - protein, 8 aa, Artificial Sequence
  CDR Sequence
WQGTHFPR

SEQ ID NO: 438 - protein, 9 aa, Artificial Sequence
  CDR Sequence
HQYNSYPLT

SEQ ID NO: 439 - protein, 6 aa, Artificial Sequence
  CDR Sequence
YNSYPL

SEQ ID NO: 440 - protein, 8 aa, Artificial Sequence
  CDR Sequence
HQYNSYPL

SEQ ID NO: 441 - protein, 9 aa, Artificial Sequence
  CDR Sequence
WQGTHFPQT

SEQ ID NO: 442 - protein, 6 aa, Artificial Sequence
  CDR Sequence
GTHFPQ

SEQ ID NO: 443 - protein, 8 aa, Artificial Sequence
  CDR Sequence
WQGTHFPQ

SEQ ID NO: 444 - protein, 9 aa, Artificial Sequence
  CDR Sequence
FQSNYLPYT

SEQ ID NO: 445 - protein, 6 aa, Artificial Sequence
  CDR Sequence
SNYLPY

SEQ ID NO: 446 - protein, 8 aa, Artificial Sequence
  CDR Sequence
FQSNYLPY

SEQ ID NO: 447 - protein, 9 aa, Artificial Sequence
  CDR Sequence
QHYYGYPFT

SEQ ID NO: 448 - protein, 6 aa, Artificial Sequence
  CDR Sequence
YYGYPF

SEQ ID NO: 449 - protein, 8 aa, Artificial Sequence
  CDR Sequence
QHYYGYPF

SEQ ID NO: 450 - protein, 9 aa, Artificial Sequence
  CDR Sequence
LQYVEFPLT

SEQ ID NO: 451 - protein, 6 aa, Artificial Sequence
  CDR Sequence
YVEFPL

SEQ ID NO: 452 - protein, 8 aa, Artificial Sequence
  CDR Sequence
LQYVEFPL

SEQ ID NO: 453 - protein, 9 aa, Artificial Sequence
  CDR Sequence
WQGTHFPLT

SEQ ID NO: 454 - protein, 6 aa, Artificial Sequence
  CDR Sequence
GTHFPL

SEQ ID NO: 455 - protein, 8 aa, Artificial Sequence
  CDR Sequence
WQGTHFPL

SEQ ID NO: 456 - protein, 9 aa, Artificial Sequence
  CDR Sequence
CQSTHFPLT

SEQ ID NO: 457 - protein, 6 aa, Artificial Sequence
  CDR Sequence
STHFPL

SEQ ID NO: 458 - protein, 8 aa, Artificial Sequence
  CDR Sequence
CQSTHFPL

SEQ ID NO: 459 - protein, 8 aa, Artificial Sequence
  CDR Sequence
LQYDNLYT

SEQ ID NO: 460 - protein, 5 aa, Artificial Sequence
  CDR Sequence
YDNLY

SEQ ID NO: 461 - protein, 7 aa, Artificial Sequence
  CDR Sequence
LQYDNLY

SEQ ID NO: 462 - protein, 6 aa, Artificial Sequence
  CDR Sequence
HQWSST

SEQ ID NO: 463 - protein, 3 aa, Artificial Sequence
  CDR Sequence
WSS

SEQ ID NO: 464 - protein, 5 aa, Artificial Sequence
  CDR Sequence
HQWSS

SEQ ID NO: 465 - protein, 9 aa, Artificial Sequence
  CDR Sequence
QQSNSWPHT

SEQ ID NO: 466 - protein, 6 aa, Artificial Sequence
  CDR Sequence
SNSWPH

SEQ ID NO: 467 - protein, 8 aa, Artificial Sequence
  CDR Sequence
QQSNSWPH

SEQ ID NO: 468 - protein, 8 aa, Artificial Sequence
  CDR Sequence
QQYSSYFT

SEQ ID NO: 469 - protein, 5 aa, Artificial Sequence
  CDR Sequence
YSSYF

SEQ ID NO: 470 - protein, 7 aa, Artificial Sequence
  CDR Sequence
QQYSSYF

SEQ ID NO: 471 - protein, 10 aa, Artificial Sequence
  CDR Sequence
QQSNSWPTFT

SEQ ID NO: 472 - protein, 7 aa, Artificial Sequence
  CDR Sequence
SNSWPTF

SEQ ID NO: 473 - protein, 9 aa, Artificial Sequence
  CDR Sequence
QQSNSWPTF

SEQ ID NO: 474 - protein, 9 aa, Artificial Sequence
  CDR Sequence
QQSNEDPYT

SEQ ID NO: 475 - protein, 6 aa, Artificial Sequence
  CDR Sequence
SNEDPY

SEQ ID NO: 476 - protein, 8 aa, Artificial Sequence
  CDR Sequence
QQSNEDPY

SEQ ID NO: 477 - protein, 9 aa, Artificial Sequence
  CDR Sequence
QQGNTLPFT

SEQ ID NO: 478 - protein, 6 aa, Artificial Sequence
  CDR Sequence
GNTLPF

SEQ ID NO: 479 - protein, 8 aa, Artificial Sequence
  CDR Sequence
QQGNTLPF

SEQ ID NO: 480 - protein, 118 aa, Artificial Sequence
  VH sequence - 1A3
EVQLQQSGPELVKPGASVKISCKASGFTFTDYYMNWVKQSHGKSLEWIGDIIPNNGVTSYNQKFKGKATLTVDKSSSTAYMELRSLTSEDSAVYYCAREWLLRGMDYWGQGTSVTVSS

SEQ ID NO: 481 - protein, 112 aa, Artificial Sequence
  VL sequence - 1A3
DIVMTQAAFSNPVTLGTSASISCRSSKSLLHSNGITYLYWYLQKPGQSPQLLIYQMSNLASGVPDRFSSSGSGTDFTLRISRVEAEDVGVYYCAQHLELTWTFGGGTKLEIK

SEQ ID NO: 482 - protein, 117 aa, Artificial Sequence
  VH sequence - P1B6
EVQLQQSGPELVKPGASVKMSCKASGYTFTDYYMNWVKQTHGKSLEWIGDINPNNGGPIYNQKFKGKATLTVDKSSSTAYMELRSLTSEDSAVYYCARSDSAWFTYWGQGTLVTVSA

SEQ ID NO: 483 - protein, 106 aa, Artificial Sequence
  VL sequence - P1B6
QIVLTQSPAIMSASPGEKVTMTCSASSSVSYMYWYQQKPGSSPRLLIYDTSNLASGVPVRFSGSGSGTFYSITISRMEAEDAATYYCQQWNSYPPTFGGGTKLEIK

SEQ ID NO: 484 - protein, 117 aa, Artificial Sequence
  VH sequence - P1H8
EVQLQQSGPELVKPGASVKISCKASGYTFTDYYMNWVKQSHGKSLEWIGDINPNNGGTTYNQKFKGKATLTVDKSSSTAYMELRSLTSEDSAVYYCARQGPWYFDVWGTGTTVTVSS

SEQ ID NO: 485 - protein, 112 aa, Artificial Sequence
  VL sequence - P1H8
DVLMTQTPLSLPVSLGDQASISCRSSQTIVHSNGYTYLEWYLQKPGQSPKLLIYKVSNRFSGVPDRFSGSGSGTDFTLKISRVEAEDLGVYYCFQGSHVPWTFGGGTKLEIK

SEQ ID NO: 486 - protein, 113 aa, Artificial Sequence
  VH sequence - P8G4
QVQLKQSGPGLVQPSQSLSITCTVSGFSLTSYGVHWVRQSPGKGLDWLGVLWSGGSTDYNAAFISRLSISKDNSKSQVFFKMNSLQADDTAIYYCARNFGDYWGQGTSVTVSS

SEQ ID NO: 487 - protein, 106 aa, Artificial Sequence
  VL sequence - P8G4
QIVLTQSPAIMSASPGEKVTMTCSASSRVSYMHWYQQKSGTSPKRWIYDTSKLASGVPARFSGSGSGTSYSLTISSMEAEDAATYYCQQWNNNPPTFGAGTTLELK

SEQ ID NO: 488 - protein, 10 aa, Artificial Sequence
  CDR Sequence
GFTFTDYYMN

SEQ ID NO: 489 - protein, 10 aa, Artificial Sequence
  CDR Sequence
GYTFTDYYMN

SEQ ID NO: 490 - protein, 5 aa, Artificial Sequence
  CDR Sequence
DYYMN

SEQ ID NO: 491 - protein, 6 aa, Artificial Sequence
  CDR Sequence
TDYYMN

SEQ ID NO: 492 - protein, 10 aa, Artificial Sequence
  CDR Sequence
GFSLTSYGVH

SEQ ID NO: 493 - protein, 8 aa, Artificial Sequence
  CDR Sequence
GFSLTSYG

SEQ ID NO: 494 - protein, 5 aa, Artificial Sequence
  CDR Sequence
SYGVH

SEQ ID NO: 495 - protein, 7 aa, Artificial Sequence
  CDR Sequence
GFSLTSY

SEQ ID NO: 496 - protein, 6 aa, Artificial Sequence
  CDR Sequence
TSYGVH

SEQ ID NO: 497 - protein, 17 aa, Artificial Sequence
  CDR Sequence
DIIPNNGVTSYNQKFKG

SEQ ID NO: 498 - protein, 8 aa, Artificial Sequence
  CDR Sequence
IIPNNGVT

SEQ ID NO: 499 - protein, 4 aa, Artificial Sequence
  CDR Sequence
PNNG

SEQ ID NO: 500 - protein, 13 aa, Artificial Sequence
  CDR Sequence
WIGDIIPNNGVTS

SEQ ID NO: 501 - protein, 10 aa, Artificial Sequence
  CDR Sequence
DIIPNNGVTS

SEQ ID NO: 502 - protein, 17 aa, Artificial Sequence
  CDR Sequence
DINPNNGGPIYNQKFKG

SEQ ID NO: 503 - protein, 8 aa, Artificial Sequence
  CDR Sequence
INPNNGGP

SEQ ID NO: 504 - protein, 13 aa, Artificial Sequence
  CDR Sequence
WIGDINPNNGGPI

SEQ ID NO: 505 - protein, 10 aa, Artificial Sequence
  CDR Sequence
DINPNNGGPI

SEQ ID NO: 506 - protein, 17 aa, Artificial Sequence
  CDR Sequence
DINPNNGGTTYNQKFKG

SEQ ID NO: 507 - protein, 8 aa, Artificial Sequence
  CDR Sequence
INPNNGGT

SEQ ID NO: 508 - protein, 13 aa, Artificial Sequence
  CDR Sequence
WIGDINPNNGGTT

SEQ ID NO: 509 - protein, 10 aa, Artificial Sequence
  CDR Sequence
DINPNNGGTT

SEQ ID NO: 510 - protein, 16 aa, Artificial Sequence
  CDR Sequence
VLWSGGSTDYNAAFIS

SEQ ID NO: 511 - protein, 7 aa, Artificial Sequence
  CDR Sequence
LWSGGST

SEQ ID NO: 512 - protein, 3 aa, Artificial Sequence
  CDR Sequence
GGS

SEQ ID NO: 513 - protein, 12 aa, Artificial Sequence
  CDR Sequence
WLGVLWSGGSTD

SEQ ID NO: 514 - protein, 9 aa, Artificial Sequence
  CDR Sequence
VLWSGGSTD

SEQ ID NO: 515 - protein, 9 aa, Artificial Sequence
  CDR Sequence
EWLLRGMDY

SEQ ID NO: 516 - protein, 11 aa, Artificial Sequence
  CDR Sequence
AREWLLRGMDY

SEQ ID NO: 517 - protein, 7 aa, Artificial Sequence
  CDR Sequence
WLLRGMD

SEQ ID NO: 518 - protein, 10 aa, Artificial Sequence
  CDR Sequence
AREWLLRGMD

SEQ ID NO: 519 - protein, 8 aa, Artificial Sequence
  CDR Sequence
SDSAWFTY

SEQ ID NO: 520 - protein, 10 aa, Artificial Sequence
  CDR Sequence
ARSDSAWFTY

SEQ ID NO: 521 - protein, 6 aa, Artificial Sequence
  CDR Sequence
DSAWFT

SEQ ID NO: 522 - protein, 9 aa, Artificial Sequence
  CDR Sequence
ARSDSAWFT

SEQ ID NO: 523 - protein, 8 aa, Artificial Sequence
  CDR Sequence
QGPWYFDV

SEQ ID NO: 524 - protein, 10 aa, Artificial Sequence
  CDR Sequence
ARQGPWYFDV

SEQ ID NO: 525 - protein, 6 aa, Artificial Sequence
  CDR Sequence
GPWYFD

SEQ ID NO: 526 - protein, 9 aa, Artificial Sequence
  CDR Sequence
ARQGPWYFD

SEQ ID NO: 527 - protein, 5 aa, Artificial Sequence
  CDR Sequence
NFGDY

SEQ ID NO: 528 - protein, 7 aa, Artificial Sequence
  CDR Sequence
ARNFGDY

SEQ ID NO: 529 - protein, 3 aa, Artificial Sequence
  CDR Sequence
FGD

SEQ ID NO: 530 - protein, 6 aa, Artificial Sequence
  CDR Sequence
ARNFGD

SEQ ID NO: 531 - protein, 16 aa, Artificial Sequence
  CDR Sequence
RSSKSLLHSNGITYLY

SEQ ID NO: 532 - protein, 11 aa, Artificial Sequence
  CDR Sequence
KSLLHSNGITY

SEQ ID NO: 533 - protein, 12 aa, Artificial Sequence
  CDR Sequence
SKSLLHSNGITY

SEQ ID NO: 534 - protein, 12 aa, Artificial Sequence
  CDR Sequence
LHSNGITYLYWY

SEQ ID NO: 535 - protein, 10 aa, Artificial Sequence
  CDR Sequence
SASSSVSYMY

SEQ ID NO: 536 - protein, 5 aa, Artificial Sequence
  CDR Sequence
SSVSY

SEQ ID NO: 537 - protein, 6 aa, Artificial Sequence
  CDR Sequence
SSSVSY

SEQ ID NO: 538 - protein, 6 aa, Artificial Sequence
  CDR Sequence
SYMYWY

SEQ ID NO: 539 - protein, 16 aa, Artificial Sequence
  CDR Sequence
RSSQTIVHSNGYTYLE

SEQ ID NO: 540 - protein, 11 aa, Artificial Sequence
  CDR Sequence
QTIVHSNGYTY

SEQ ID NO: 541 - protein, 12 aa, Artificial Sequence
  CDR Sequence
SQTIVHSNGYTY

SEQ ID NO: 542 - protein, 12 aa, Artificial Sequence
  CDR Sequence
VHSNGYTYLEWY

SEQ ID NO: 543 - protein, 10 aa, Artificial Sequence
  CDR Sequence
SASSRVSYMH

SEQ ID NO: 544 - protein, 5 aa, Artificial Sequence
  CDR Sequence
SRVSY

SEQ ID NO: 545 - protein, 6 aa, Artificial Sequence
  CDR Sequence
SSRVSY

SEQ ID NO: 546 - protein, 6 aa, Artificial Sequence
  CDR Sequence
SYMHWY

SEQ ID NO: 547 - protein, 7 aa, Artificial Sequence
  CDR Sequence
QMSNLAS

SEQ ID NO: 548 - protein, 3 aa, Artificial Sequence
  CDR Sequence
QMS

SEQ ID NO: 549 - protein, 10 aa, Artificial Sequence
  CDR Sequence
LLIYQMSNLA

SEQ ID NO: 550 - protein, 7 aa, Artificial Sequence
  CDR Sequence
DTSNLAS

SEQ ID NO: 551 - protein, 3 aa, Artificial Sequence
  CDR Sequence
DTS

SEQ ID NO: 552 - protein, 10 aa, Artificial Sequence
  CDR Sequence
LLIYDTSNLA

SEQ ID NO: 553 - protein, 7 aa, Artificial Sequence
  CDR Sequence
KVSNRFS

SEQ ID NO: 554 - protein, 3 aa, Artificial Sequence
  CDR Sequence
KVS

SEQ ID NO: 555 - protein, 10 aa, Artificial Sequence
  CDR Sequence
LLIYKVSNRF

SEQ ID NO: 556 - protein, 7 aa, Artificial Sequence
  CDR Sequence
DTSKLAS

SEQ ID NO: 557 - protein, 10 aa, Artificial Sequence
  CDR Sequence
RWIYDTSKLA

SEQ ID NO: 558 - protein, 9 aa, Artificial Sequence
  CDR Sequence
AQHLELTWT

SEQ ID NO: 559 - protein, 6 aa, Artificial Sequence
  CDR Sequence
HLELTW

SEQ ID NO: 560 - protein, 8 aa, Artificial Sequence
  CDR Sequence
AQHLELTW

SEQ ID NO: 561 - protein, 9 aa, Artificial Sequence
  CDR Sequence
QQWNSYPPT

SEQ ID NO: 562 - protein, 6 aa, Artificial Sequence
  CDR Sequence
WNSYPP

SEQ ID NO: 563 - protein, 8 aa, Artificial Sequence
  CDR Sequence
QQWNSYPP

SEQ ID NO: 564 - protein, 9 aa, Artificial Sequence
  CDR Sequence
FQGSHVPWT

SEQ ID NO: 565 - protein, 7 aa, Artificial Sequence
  CDR Sequence
QGSHVPW

SEQ ID NO: 566 - protein, 8 aa, Artificial Sequence
  CDR Sequence
FQGSHVPW

SEQ ID NO: 567 - protein, 9 aa, Artificial Sequence
  CDR Sequence
QQWNNNPPT

SEQ ID NO: 568 - protein, 6 aa, Artificial Sequence
  CDR Sequence
WNNNPP

SEQ ID NO: 569 - protein, 8 aa, Artificial Sequence
  CDR Sequence
QQWNNNPP

SEQ ID NO: 570 - protein, 25 aa, Artificial Sequence
  VH Framework 1 (FR1)
QVQLQESGPGLVKPSETLSLTCTVS

SEQ ID NO: 571 - protein, 25 aa, Artificial Sequence
  VH Framework 1 (FR1)
QMQLQESGPGLVKPSETLSLTCTVS

SEQ ID NO: 572 - protein, 25 aa, Artificial Sequence [sequence omitted]

SEQ ID NO: 573 - protein, 25 aa, Artificial Sequence
  VH Framework 1 (FR1)
QIQLVQSGAEVKKPGSSVKVSCKAS

SEQ ID NO: 574 - protein, 25 aa, Artificial Sequence
  VH Framework 1 (FR1)
QVQLVQSGAEVKKPGATVKISCKVS

SEQ ID NO: 575 - protein, 25 aa, Artificial Sequence
  VH Framework 1 (FR1)
QIQLVQSGAEVKKPGATVKISCKVS

SEQ ID NO: 576 - protein, 25 aa, Artificial Sequence
  VH Framework 1 (FR1)
QVQLVQSGAEVVKPGSSVKVSCKAS

SEQ ID NO: 577 - protein, 25 aa, Artificial Sequence [sequence omitted]

SEQ ID NO: 578 - protein, 25 aa, Artificial Sequence
  VH Framework 1 (FR1)
EVQLVQSGAEVKKPGESLKISCKGS

SEQ ID NO: 579 - protein, 14 aa, Artificial Sequence
  VH Framework 2 (FR2)
WIRQPPGKGLEWIG

SEQ ID NO: 580 - protein, 14 aa, Artificial Sequence
  VH Framework 2 (FR2)
WIRQPPGKGLEWLG

SEQ ID NO: 581 - protein, 14 aa, Artificial Sequence
  VH Framework 2 (FR2)
WVRQAPGQGLEWMG

SEQ ID NO: 582 - protein, 14 aa, Artificial Sequence
  VH Framework 2 (FR2)
WVRQAPGKGLEWMG

SEQ ID NO: 583 - protein, 14 aa, Artificial Sequence
  VH Framework 2 (FR2)
WVRQAPGQALEWMG

SEQ ID NO: 584 - protein, 14 aa, Artificial Sequence
  VH Framework 2 (FR2)
WVRQAPGQGLKWMG

SEQ ID NO: 585 - protein, 14 aa, Artificial Sequence
  VH Framework 2 (FR2)
WVRQAPGKALEWMG

SEQ ID NO: 586 - protein, 14 aa, Artificial Sequence
  VH Framework 2 (FR2)
WVRQAPGKGLKWMG

SEQ ID NO: 587 - protein, 14 aa, Artificial Sequence
  VH Framework 2 (FR2)
WVRQAPGQALKWMG

SEQ ID NO: 588 - protein, 14 aa, Artificial Sequence
  VH Framework 2 (FR2)
WVRQAPGKALKWMG

SEQ ID NO: 589 - protein, 14 aa, Artificial Sequence
  VH Framework 2 (FR2)
WVKQAPGQGLEWIG

SEQ ID NO: 590 - protein, 14 aa, Artificial Sequence
  VH Framework 2 (FR2)
WVRQAPGQGLEWIG

SEQ ID NO: 591 - protein, 14 aa, Artificial Sequence
  VH Framework 2 (FR2)
WVRQAPGQGLEWIA

SEQ ID NO: 592 - protein, 14 aa, Artificial Sequence
  VH Framework 2 (FR2)
WVKQAPGQGLEWIG

SEQ ID NO: 593 - protein, 14 aa, Artificial Sequence
  VH Framework 2 (FR2)
WVKQAPGQGLEWIA

SEQ ID NO: 594 - protein, 14 aa, Artificial Sequence
  VH Framework 2 (FR2)
WVRQAPGQGLEWIA

SEQ ID NO: 595 - protein, 14 aa, Artificial Sequence
  VH Framework 2 (FR2)
WVKQAPGQGLEWIA

SEQ ID NO: 596 - protein, 14 aa, Artificial Sequence
  VH Framework 2 (FR2)
WMQQAPGKGLEWIG

SEQ ID NO: 597 - protein, 14 aa, Artificial Sequence
  VH Framework 2 (FR2)
WVRQAPGQRLEWMG

SEQ ID NO: 598 - protein, 14 aa, Artificial Sequence
  VH Framework 2 (FR2)
WVRQAPGQRLEWIG

SEQ ID NO: 599 - protein, 14 aa, Artificial Sequence
  VH Framework 2 (FR2)
WVRQAPGQRLEWMA

SEQ ID NO: 600 - protein, 14 aa, Artificial Sequence
  VH Framework 2 (FR2)
WVRQAPGQRLEWIA

SEQ ID NO: 601 - protein, 14 aa, Artificial Sequence
  VH Framework 2 (FR2)
WVRQMPGKGLEWMG

SEQ ID NO: 602 - protein, 14 aa, Artificial Sequence
  VH Framework 2 (FR2)
WVRQMPGKGLEWIG

SEQ ID NO: 603 - protein, 32 aa, Artificial Sequence
  VH Framework 3 (FR3)
RVTISVDTSKNQFSLKLSSVTAADTAVYYCAR

SEQ ID NO: 604 - protein, 32 aa, Artificial Sequence
  VH Framework 3 (FR3)
RLTISVDTSKNQFSLKLSSVTAADTAVYYCAR

SEQ ID NO: 605 - protein, 32 aa, Artificial Sequence
  VH Framework 3 (FR3)
RVTISKDTSKNQFSLKLSSVTAADTAVYYCAR

SEQ ID NO: 606 - protein, 32 aa, Artificial Sequence
  VH Framework 3 (FR3)
RVTISVDNSKNQFSLKLSSVTAADTAVYYCAR

SEQ ID NO: 607 - protein, 32 aa, Artificial Sequence
  VH Framework 3 (FR3)
RVTISVDTSKSQFSLKLSSVTAADTAVYYCAR

SEQ ID NO: 608 - protein, 32 aa, Artificial Sequence
  VH Framework 3 (FR3)
RVTISVDTSKNQVSLKLSSVTAADTAVYYCAR

SEQ ID NO: 609 - protein, 32 aa, Artificial Sequence
  VH Framework 3 (FR3)
RVTISVDTSKNQFSFKLSSVTAADTAVYYCAR

SEQ ID NO: 610 - protein, 32 aa, Artificial Sequence
  VH Framework 3 (FR3)
RVTISVDTSKNQFSLKMSSVTAADTAVYYCAR

SEQ ID NO: 611 - protein, 32 aa, Artificial Sequence
  VH Framework 3 (FR3)
RVTISVDTSKNQFSLKLSSLTAADTAVYYCAR

SEQ ID NO: 612 - protein, 32 aa, Artificial Sequence
  VH Framework 3 (FR3)
RVTISVDTSKNQFSLKLSSVQAADTAVYYCAR

SEQ ID NO: 613 - protein, 32 aa, Artificial Sequence
  VH Framework 3 (FR3)
RVTISVDTSKNQFSLKLSSVTAQDTAVYYCAR

SEQ ID NO: 614 - protein, 32 aa, Artificial Sequence
  VH Framework 3 (FR3)
RLTISKDTSKNQFSLKLSSVTAADTAVYYCAR

SEQ ID NO: 615 - protein, 32 aa, Artificial Sequence
  VH Framework 3 (FR3)
RLTISVDNSKNQFSLKLSSVTAADTAVYYCAR

SEQ ID NO: 616 - protein, 32 aa, Artificial Sequence
  VH Framework 3 (FR3)
RLTISVDTSKSQFSLKLSSVTAADTAVYYCAR

SEQ ID NO: 617 - protein, 32 aa, Artificial Sequence
  VH Framework 3 (FR3)
RLTISVDTSKNQVSLKLSSVTAADTAVYYCAR

SEQ ID NO: 618 - protein, 32 aa, Artificial Sequence
  VH Framework 3 (FR3)
RLTISVDTSKNQFSFKLSSVTAADTAVYYCAR

SEQ ID NO: 619 - protein, 32 aa, Artificial Sequence
  VH Framework 3 (FR3)
RLTISVDTSKNQFSLKMSSVTAADTAVYYCAR

SEQ ID NO: 620 - protein, 32 aa, Artificial Sequence
  VH Framework 3 (FR3)
RLTISVDTSKNQFSLKLSSLTAADTAVYYCAR

SEQ ID NO: 621 - protein, 32 aa, Artificial Sequence
  VH Framework 3 (FR3)
RLTISVDTSKNQFSLKLSSVQAADTAVYYCAR

SEQ ID NO: 622 - protein, 32 aa, Artificial Sequence
  VH Framework 3 (FR3)
RLTISVDTSKNQFSLKLSSVTAQDTAVYYCAR

SEQ ID NO: 623 - protein, 32 aa, Artificial Sequence
  VH Framework 3 (FR3)
RVTISKDNSKNQFSLKLSSVTAADTAVYYCAR

SEQ ID NO: 624 - protein, 32 aa, Artificial Sequence
  VH Framework 3 (FR3)
RVTISKDTSKSQFSLKLSSVTAADTAVYYCAR

SEQ ID NO: 625 - protein, 32 aa, Artificial Sequence
  VH Framework 3 (FR3)
RVTISKDTSKNQVSLKLSSVTAADTAVYYCAR

SEQ ID NO: 626 - protein, 32 aa, Artificial Sequence
  VH Framework 3 (FR3)
RVTISKDTSKNQFSFKLSSVTAADTAVYYCAR

SEQ ID NO: 627 - protein, 32 aa, Artificial Sequence
  VH Framework 3 (FR3)
RVTISKDTSKNQFSLKMSSVTAADTAVYYCAR

SEQ ID NO: 628 - protein, 32 aa, Artificial Sequence
  VH Framework 3 (FR3)
RVTISKDTSKNQFSLKLSSLTAADTAVYYCAR

SEQ ID NO: 629 - protein, 32 aa, Artificial Sequence
  VH Framework 3 (FR3)
RVTISKDTSKNQFSLKLSSVQAADTAVYYCAR

SEQ ID NO: 630 - protein, 32 aa, Artificial Sequence
  VH Framework 3 (FR3)
RVTISKDTSKNQFSLKLSSVTAQDTAVYYCAR

SEQ ID NO: 631 - protein, 32 aa, Artificial Sequence
  VH Framework 3 (FR3)
RVTISVDNSKSQFSLKLSSVTAADTAVYYCAR

SEQ ID NO: 632 - protein, 32 aa, Artificial Sequence
  VH Framework 3 (FR3)
RVTISVDNSKNQVSLKLSSVTAADTAVYYCAR

SEQ ID NO: 633 - protein, 32 aa, Artificial Sequence
  VH Framework 3 (FR3)
RVTISVDNSKNQFSFKLSSVTAADTAVYYCAR

SEQ ID NO: 634 - protein, 32 aa, Artificial Sequence
  VH Framework 3 (FR3)
RVTISVDNSKNQFSLKMSSVTAADTAVYYCAR

SEQ ID NO: 635 - protein, 32 aa, Artificial Sequence
  VH Framework 3 (FR3)
RVTISVDNSKNQFSLKLSSLTAADTAVYYCAR

SEQ ID NO: 636 - protein, 32 aa, Artificial Sequence
  VH Framework 3 (FR3)
RVTISVDNSKNQFSLKLSSVQAADTAVYYCAR

SEQ ID NO: 637 - protein, 32 aa, Artificial Sequence
  VH Framework 3 (FR3)
RVTISVDNSKNQFSLKLSSVTAQDTAVYYCAR

SEQ ID NO: 638 - protein, 32 aa, Artificial Sequence
  VH Framework 3 (FR3)
RVTISVDTSKSQVSLKLSSVTAADTAVYYCAR

SEQ ID NO: 639 - protein, 32 aa, Artificial Sequence
  VH Framework 3 (FR3)
RVTISVDTSKSQFSFKLSSVTAADTAVYYCAR

SEQ ID NO: 640 - protein, 32 aa, Artificial Sequence
  VH Framework 3 (FR3)
RVTISVDTSKSQFSLKMSSVTAADTAVYYCAR

SEQ ID NO: 641 - protein, 32 aa, Artificial Sequence
  VH Framework 3 (FR3)
RVTISVDTSKSQFSLKLSSLTAADTAVYYCAR

SEQ ID NO: 642 - protein, 32 aa, Artificial Sequence
  VH Framework 3 (FR3)
RVTISVDTSKSQFSLKLSSVQAADTAVYYCAR

SEQ ID NO: 643 - protein, 32 aa, Artificial Sequence
  VH Framework 3 (FR3)
RVTISVDTSKSQFSLKLSSVTAQDTAVYYCAR

SEQ ID NO: 644 - protein, 32 aa, Artificial Sequence
  VH Framework 3 (FR3)
RVTISVDTSKNQVSFKLSSVTAADTAVYYCAR

SEQ ID NO: 645 - protein, 32 aa, Artificial Sequence
  VH Framework 3 (FR3)
RVTISVDTSKNQVSLKMSSVTAADTAVYYCAR

SEQ ID NO: 646 - protein, 32 aa, Artificial Sequence
  VH Framework 3 (FR3)
RVTISVDTSKNQVSLKLSSLTAADTAVYYCAR

SEQ ID NO: 647 - protein, 32 aa, Artificial Sequence
  VH Framework 3 (FR3)
RVTISVDTSKNQVSLKLSSVQAADTAVYYCAR

SEQ ID NO: 648 - protein, 32 aa, Artificial Sequence
  VH Framework 3 (FR3)
RVTISVDTSKNQVSLKLSSVTAQDTAVYYCAR

SEQ ID NO: 649 - protein, 32 aa, Artificial Sequence
  VH Framework 3 (FR3)
RVTISVDTSKNQFSFKMSSVTAADTAVYYCAR

SEQ ID NO: 650 - protein, 32 aa, Artificial Sequence
  VH Framework 3 (FR3)
RVTISVDTSKNQFSFKLSSLTAADTAVYYCAR

SEQ ID NO: 651 - protein, 32 aa, Artificial Sequence
  VH Framework 3 (FR3)
RVTISVDTSKNQFSFKLSSVQAADTAVYYCAR

SEQ ID NO: 652 - protein, 32 aa, Artificial Sequence
  VH Framework 3 (FR3)
RVTISVDTSKNQFSFKLSSVTAQDTAVYYCAR

SEQ ID NO: 653 - protein, 32 aa, Artificial Sequence
  VH Framework 3 (FR3)
RVTISVDTSKNQFSLKMSSLTAADTAVYYCAR

SEQ ID NO: 654 - protein, 32 aa, Artificial Sequence
  VH Framework 3 (FR3)
RVTISVDTSKNQFSLKMSSVQAADTAVYYCAR

SEQ ID NO: 655 - protein, 32 aa, Artificial Sequence
  VH Framework 3 (FR3)
RVTISVDTSKNQFSLKMSSVTAQDTAVYYCAR

SEQ ID NO: 656 - protein, 32 aa, Artificial Sequence
  VH Framework 3 (FR3)
RVTISVDTSKNQFSLKLSSLQAADTAVYYCAR

SEQ ID NO: 657 - protein, 32 aa, Artificial Sequence
  VH Framework 3 (FR3)
RVTISVDTSKNQFSLKLSSLTAQDTAVYYCAR

SEQ ID NO: 658 - protein, 32 aa, Artificial Sequence
  VH Framework 3 (FR3)
RVTISVDTSKNQFSLKLSSVQAQDTAVYYCAR

SEQ ID NO: 659 - protein, 32 aa, Artificial Sequence
  VH Framework 3 (FR3)
RLTISKDNSKNQFSLKLSSVTAADTAVYYCAR

SEQ ID NO: 660 - protein, 32 aa, Artificial Sequence
  VH Framework 3 (FR3)
RLTISKDTSKSQFSLKLSSVTAADTAVYYCAR

SEQ ID NO: 661 - protein, 32 aa, Artificial Sequence
  VH Framework 3 (FR3)
RLTISKDTSKNQVSLKLSSVTAADTAVYYCAR

SEQ ID NO: 662 - protein, 32 aa, Artificial Sequence
  VH Framework 3 (FR3)
RLTISKDTSKNQFSFKLSSVTAADTAVYYCAR

SEQ ID NO: 663 - protein, 32 aa, Artificial Sequence
  VH Framework 3 (FR3)
RLTISKDTSKNQFSLKMSSVTAADTAVYYCAR

SEQ ID NO: 664 - protein, 32 aa, Artificial Sequence
  VH Framework 3 (FR3)
RLTISKDTSKNQFSLKLSSLTAADTAVYYCAR

SEQ ID NO: 665 - protein, 32 aa, Artificial Sequence
  VH Framework 3 (FR3)
RLTISKDTSKNQFSLKLSSVQAADTAVYYCAR

SEQ ID NO: 666 - protein, 32 aa, Artificial Sequence
  VH Framework 3 (FR3)
RLTISKDTSKNQFSLKLSSVTAQDTAVYYCAR

SEQ ID NO: 667 - protein, 32 aa, Artificial Sequence
  VH Framework 3 (FR3)
RLTISVDNSKSQFSLKLSSVTAADTAVYYCAR

SEQ ID NO: 668 - protein, 32 aa, Artificial Sequence
  VH Framework 3 (FR3)
RLTISVDNSKNQVSLKLSSVTAADTAVYYCAR

SEQ ID NO: 669 - protein, 32 aa, Artificial Sequence
  VH Framework 3 (FR3)
RLTISVDNSKNQFSFKLSSVTAADTAVYYCAR

SEQ ID NO: 670 - protein, 32 aa, Artificial Sequence
  VH Framework 3 (FR3)
RLTISVDNSKNQFSLKMSSVTAADTAVYYCAR

SEQ ID NO: 671 - protein, 32 aa, Artificial Sequence
  VH Framework 3 (FR3)
RLTISVDNSKNQFSLKLSSLTAADTAVYYCAR

SEQ ID NO: 672 - protein, 32 aa, Artificial Sequence
  VH Framework 3 (FR3)
RLTISVDNSKNQFSLKLSSVQAADTAVYYCAR

SEQ ID NO: 673 - protein, 32 aa, Artificial Sequence
  VH Framework 3 (FR3)
RLTISVDNSKNQFSLKLSSVTAQDTAVYYCAR

SEQ ID NO: 674 - protein, 32 aa, Artificial Sequence
  VH Framework 3 (FR3)
RLTISVDTSKSQVSLKLSSVTAADTAVYYCAR

SEQ ID NO: 675 - protein, 32 aa, Artificial Sequence
  VH Framework 3 (FR3)
RLTISVDTSKSQFSFKLSSVTAADTAVYYCAR

SEQ ID NO: 676 - protein, 32 aa, Artificial Sequence
  VH Framework 3 (FR3)
RLTISVDTSKSQFSLKMSSVTAADTAVYYCAR

SEQ ID NO: 677 - protein, 32 aa, Artificial Sequence
  VH Framework 3 (FR3)
RLTISVDTSKSQFSLKLSSLTAADTAVYYCAR

SEQ ID NO: 678 - protein, 32 aa, Artificial Sequence
  VH Framework 3 (FR3)
RLTISVDTSKSQFSLKLSSVQAADTAVYYCAR

SEQ ID NO: 679 - protein, 32 aa, Artificial Sequence
  VH Framework 3 (FR3)
RLTISVDTSKSQFSLKLSSVTAQDTAVYYCAR

SEQ ID NO: 680 - protein, 32 aa, Artificial Sequence
  VH Framework 3 (FR3)
RLTISVDTSKNQVSFKLSSVTAADTAVYYCAR

SEQ ID NO: 681 - protein, 32 aa, Artificial Sequence
  VH Framework 3 (FR3)
RLTISVDTSKNQVSLKMSSVTAADTAVYYCAR

SEQ ID NO: 682 - protein, 32 aa, Artificial Sequence
  VH Framework 3 (FR3)
RLTISVDTSKNQVSLKLSSLTAADTAVYYCAR

SEQ ID NO: 683 - protein, 32 aa, Artificial Sequence
  VH Framework 3 (FR3)
RLTISVDTSKNQVSLKLSSVQAADTAVYYCAR

SEQ ID NO: 684 - protein, 32 aa, Artificial Sequence
  VH Framework 3 (FR3)
RLTISVDTSKNQVSLKLSSVTAQDTAVYYCAR

SEQ ID NO: 685 - protein, 32 aa, Artificial Sequence
  VH Framework 3 (FR3)
RLTISVDTSKNQFSFKMSSVTAADTAVYYCAR

SEQ ID NO: 686 - protein, 32 aa, Artificial Sequence
  VH Framework 3 (FR3)
RLTISVDTSKNQFSFKLSSLTAADTAVYYCAR

SEQ ID NO: 687 - protein, 32 aa, Artificial Sequence
  VH Framework 3 (FR3)
RLTISVDTSKNQFSFKLSSVQAADTAVYYCAR

SEQ ID NO: 688 - protein, 32 aa, Artificial Sequence
  VH Framework 3 (FR3)
RLTISVDTSKNQFSFKLSSVTAQDTAVYYCAR

SEQ ID NO: 689 - protein, 32 aa, Artificial Sequence
  VH Framework 3 (FR3)
RLTISVDTSKNQFSLKMSSLTAADTAVYYCAR

SEQ ID NO: 690 - protein, 32 aa, Artificial Sequence
  VH Framework 3 (FR3)
RLTISVDTSKNQFSLKMSSVQAADTAVYYCAR

SEQ ID NO: 691 - protein, 32 aa, Artificial Sequence
  VH Framework 3 (FR3)
RLTISVDTSKNQFSLKMSSVTAQDTAVYYCAR

SEQ ID NO: 692 - protein, 32 aa, Artificial Sequence
  VH Framework 3 (FR3)
RLTISVDTSKNQFSLKLSSLQAADTAVYYCAR

SEQ ID NO: 693 - protein, 32 aa, Artificial Sequence
  VH Framework 3 (FR3)
RLTISVDTSKNQFSLKLSSLTAQDTAVYYCAR

SEQ ID NO: 694 - protein, 32 aa, Artificial Sequence
  VH Framework 3 (FR3)
RLTISVDTSKNQFSLKLSSVQAQDTAVYYCAR

SEQ ID NO: 695 - protein, 32 aa, Artificial Sequence
  VH Framework 3 (FR3)
RVTISKDNSKSQFSLKLSSVTAADTAVYYCAR

SEQ ID NO: 696 - protein, 32 aa, Artificial Sequence
  VH Framework 3 (FR3)
RVTISKDNSKNQVSLKLSSVTAADTAVYYCAR

SEQ ID NO: 697 - protein, 32 aa, Artificial Sequence
  VH Framework 3 (FR3)
RVTISKDNSKNQFSFKLSSVTAADTAVYYCAR

SEQ ID NO: 698 - protein, 32 aa, Artificial Sequence
  VH Framework 3 (FR3)
RVTISKDNSKNQFSLKMSSVTAADTAVYYCAR

SEQ ID NO: 699 - protein, 32 aa, Artificial Sequence
  VH Framework 3 (FR3)
RVTISKDNSKNQFSLKLSSLTAADTAVYYCAR

SEQ ID NO: 700 - protein, 32 aa, Artificial Sequence
  VH Framework 3 (FR3)
RVTISKDNSKNQFSLKLSSVQAADTAVYYCAR

SEQ ID NO: 701 - protein, 32 aa, Artificial Sequence
  VH Framework 3 (FR3)
RVTISKDNSKNQFSLKLSSVTAQDTAVYYCAR

SEQ ID NO: 702 - protein, 32 aa, Artificial Sequence
  VH Framework 3 (FR3)
RVTISKDTSKSQVSLKLSSVTAADTAVYYCAR

SEQ ID NO: 703 - protein, 32 aa, Artificial Sequence
  VH Framework 3 (FR3)
RVTISKDTSKSQFSFKLSSVTAADTAVYYCAR

SEQ ID NO: 704 - protein, 32 aa, Artificial Sequence
  VH Framework 3 (FR3)
RVTISKDTSKSQFSLKMSSVTAADTAVYYCAR

SEQ ID NO: 705 - protein, 32 aa, Artificial Sequence
  VH Framework 3 (FR3)
RVTISKDTSKSQFSLKLSSLTAADTAVYYCAR

SEQ ID NO: 706 - protein, 32 aa, Artificial Sequence
  VH Framework 3 (FR3)
RVTISKDTSKSQFSLKLSSVQAADTAVYYCAR

SEQ ID NO: 707 - protein, 32 aa, Artificial Sequence
  VH Framework 3 (FR3)
RVTISKDTSKSQFSLKLSSVTAQDTAVYYCAR

SEQ ID NO: 708 - protein, 32 aa, Artificial Sequence
  VH Framework 3 (FR3)
RVTISKDTSKNQVSFKLSSVTAADTAVYYCAR

SEQ ID NO: 709 - protein, 32 aa, Artificial Sequence
  VH Framework 3 (FR3)
RVTISKDTSKNQVSLKMSSVTAADTAVYYCAR

SEQ ID NO: 710 - protein, 32 aa, Artificial Sequence
  VH Framework 3 (FR3)
RVTISKDTSKNQVSLKLSSLTAADTAVYYCAR

SEQ ID NO: 711 - protein, 32 aa, Artificial Sequence
  VH Framework 3 (FR3)
RVTISKDTSKNQVSLKLSSVQAADTAVYYCAR

SEQ ID NO: 712 - protein, 32 aa, Artificial Sequence
  VH Framework 3 (FR3)
RVTISKDTSKNQVSLKLSSVTAQDTAVYYCAR

SEQ ID NO: 713 - protein, 32 aa, Artificial Sequence
  VH Framework 3 (FR3)
RVTISKDTSKNQFSFKMSSVTAADTAVYYCAR

SEQ ID NO: 714 - protein, 32 aa, Artificial Sequence
  VH Framework 3 (FR3)
RVTISKDTSKNQFSFKLSSLTAADTAVYYCAR

SEQ ID NO: 715 - protein, 32 aa, Artificial Sequence
  VH Framework 3 (FR3)
RVTISKDTSKNQFSFKLSSVQAADTAVYYCAR

SEQ ID NO: 716 - protein, 32 aa, Artificial Sequence
  VH Framework 3 (FR3)
RVTISKDTSKNQFSFKLSSVTAQDTAVYYCAR

SEQ ID NO: 717 - protein, 32 aa, Artificial Sequence
  VH Framework 3 (FR3)
RVTISKDTSKNQFSLKMSSLTAADTAVYYCAR

SEQ ID NO: 718 - protein, 32 aa, Artificial Sequence
  VH Framework 3 (FR3)
RVTISKDTSKNQFSLKMSSVQAADTAVYYCAR

SEQ ID NO: 719 - protein, 32 aa, Artificial Sequence
  VH Framework 3 (FR3)
RVTISKDTSKNQFSLKMSSVTAQDTAVYYCAR

SEQ ID NO: 720 - protein, 32 aa, Artificial Sequence
  VH Framework 3 (FR3)
RVTISKDTSKNQFSLKLSSLQAADTAVYYCAR

SEQ ID NO: 721 - protein, 32 aa, Artificial Sequence
  VH Framework 3 (FR3)
RVTISKDTSKNQFSLKLSSLTAQDTAVYYCAR

SEQ ID NO: 722 - protein, 32 aa, Artificial Sequence
  VH Framework 3 (FR3)
RVTISKDTSKNQFSLKLSSVQAQDTAVYYCAR

SEQ ID NO: 723 - protein, 32 aa, Artificial Sequence
  VH Framework 3 (FR3)
RVTISVDNSKSQVSLKLSSVTAADTAVYYCAR

SEQ ID NO: 724 - protein, 32 aa, Artificial Sequence
  VH Framework 3 (FR3)
RVTISVDNSKSQFSFKLSSVTAADTAVYYCAR

SEQ ID NO: 725 - protein, 32 aa, Artificial Sequence
  VH Framework 3 (FR3)
RVTISVDNSKSQFSLKMSSVTAADTAVYYCAR

SEQ ID NO: 726 - protein, 32 aa, Artificial Sequence
  VH Framework 3 (FR3)
RVTISVDNSKSQFSLKLSSLTAADTAVYYCAR

SEQ ID NO: 727 - protein, 32 aa, Artificial Sequence
  VH Framework 3 (FR3)
RVTISVDNSKSQFSLKLSSVQAADTAVYYCAR

SEQ ID NO: 728 - protein, 32 aa, Artificial Sequence
  VH Framework 3 (FR3)
RVTISVDNSKSQFSLKLSSVTAQDTAVYYCAR

SEQ ID NO: 729 - protein, 32 aa, Artificial Sequence
  VH Framework 3 (FR3)
RVTISVDNSKNQVSFKLSSVTAADTAVYYCAR

SEQ ID NO: 730 - protein, 32 aa, Artificial Sequence
  VH Framework 3 (FR3)
RVTISVDNSKNQVSLKMSSVTAADTAVYYCAR

SEQ ID NO: 731 - protein, 32 aa, Artificial Sequence
  VH Framework 3 (FR3)
RVTISVDNSKNQVSLKLSSLTAADTAVYYCAR

SEQ ID NO: 732 - protein, 32 aa, Artificial Sequence
  VH Framework 3 (FR3)
RVTISVDNSKNQVSLKLSSVQAADTAVYYCAR

SEQ ID NO: 733 - protein, 32 aa, Artificial Sequence
  VH Framework 3 (FR3)
RVTISVDNSKNQVSLKLSSVTAQDTAVYYCAR

SEQ ID NO: 734 - protein, 32 aa, Artificial Sequence
  VH Framework 3 (FR3)
RVTISVDNSKNQFSFKMSSVTAADTAVYYCAR

SEQ ID NO: 735 - protein, 32 aa, Artificial Sequence
  VH Framework 3 (FR3)
RVTISVDNSKNQFSFKLSSLTAADTAVYYCAR

SEQ ID NO: 736 - protein, 32 aa, Artificial Sequence
  VH Framework 3 (FR3)
RVTISVDNSKNQFSFKLSSVQAADTAVYYCAR

SEQ ID NO: 737 - protein, 32 aa, Artificial Sequence
  VH Framework 3 (FR3)
RVTISVDNSKNQFSFKLSSVTAQDTAVYYCAR

SEQ ID NO: 738 - protein, 32 aa, Artificial Sequence
  VH Framework 3 (FR3)
RVTISVDNSKNQFSLKMSSLTAADTAVYYCAR

SEQ ID NO: 739 - protein, 32 aa, Artificial Sequence
  VH Framework 3 (FR3)
RVTISVDNSKNQFSLKMSSVQAADTAVYYCAR

SEQ ID NO: 740 - protein, 32 aa, Artificial Sequence
  VH Framework 3 (FR3)
RVTISVDNSKNQFSLKMSSVTAQDTAVYYCAR

SEQ ID NO: 741 - protein, 32 aa, Artificial Sequence
  VH Framework 3 (FR3)
RVTISVDNSKNQFSLKLSSLQAADTAVYYCAR

SEQ ID NO: 742 - protein, 32 aa, Artificial Sequence
  VH Framework 3 (FR3)
RVTISVDNSKNQFSLKLSSLTAQDTAVYYCAR

SEQ ID NO: 743 - protein, 32 aa, Artificial Sequence
  VH Framework 3 (FR3)
RVTISVDNSKNQFSLKLSSVQAQDTAVYYCAR

SEQ ID NO: 744 - protein, 32 aa, Artificial Sequence
  VH Framework 3 (FR3)
RVTISVDTSKSQVSFKLSSVTAADTAVYYCAR

SEQ ID NO: 745 - protein, 32 aa, Artificial Sequence
  VH Framework 3 (FR3)
RVTISVDTSKSQVSLKMSSVTAADTAVYYCAR

SEQ ID NO: 746 - protein, 32 aa, Artificial Sequence
  VH Framework 3 (FR3)
RVTISVDTSKSQVSLKLSSLTAADTAVYYCAR

SEQ ID NO: 747 - protein, 32 aa, Artificial Sequence
  VH Framework 3 (FR3)
RVTISVDTSKSQVSLKLSSVQAADTAVYYCAR

SEQ ID NO: 748 - protein, 32 aa, Artificial Sequence
  VH Framework 3 (FR3)
RVTISVDTSKSQVSLKLSSVTAQDTAVYYCAR

SEQ ID NO: 749 - protein, 32 aa, Artificial Sequence
  VH Framework 3 (FR3)
RVTISVDTSKSQFSFKMSSVTAADTAVYYCAR

SEQ ID NO: 750 - protein, 32 aa, Artificial Sequence
  VH Framework 3 (FR3)
RVTISVDTSKSQFSFKLSSLTAADTAVYYCAR

SEQ ID NO: 751 - protein, 32 aa, Artificial Sequence
  VH Framework 3 (FR3)
RVTISVDTSKSQFSFKLSSVQAADTAVYYCAR

SEQ ID NO: 752 - protein, 32 aa, Artificial Sequence
  VH Framework 3 (FR3)
RVTISVDTSKSQFSFKLSSVTAQDTAVYYCAR

SEQ ID NO: 753 - protein, 32 aa, Artificial Sequence
  VH Framework 3 (FR3)
RVTISVDTSKSQFSLKMSSLTAADTAVYYCAR

SEQ ID NO: 754 - protein, 32 aa, Artificial Sequence
  VH Framework 3 (FR3)
RVTISVDTSKSQFSLKMSSVQAADTAVYYCAR

SEQ ID NO: 755 - protein, 32 aa, Artificial Sequence
  VH Framework 3 (FR3)
RVTISVDTSKSQFSLKMSSVTAQDTAVYYCAR

SEQ ID NO: 756 - protein, 32 aa, Artificial Sequence
  VH Framework 3 (FR3)
RVTISVDTSKSQFSLKLSSLQAADTAVYYCAR

SEQ ID NO: 757 - protein, 32 aa, Artificial Sequence
  VH Framework 3 (FR3)
RVTISVDTSKSQFSLKLSSLTAQDTAVYYCAR

SEQ ID NO: 758 - protein, 32 aa, Artificial Sequence
  VH Framework 3 (FR3)
RVTISVDTSKSQFSLKLSSVQAQDTAVYYCAR

SEQ ID NO: 759 - protein, 32 aa, Artificial Sequence
  VH Framework 3 (FR3)
RVTISVDTSKNQVSFKMSSVTAADTAVYYCAR

SEQ ID NO: 760 - protein, 32 aa, Artificial Sequence
  VH Framework 3 (FR3)
RVTISVDTSKNQVSFKLSSLTAADTAVYYCAR

SEQ ID NO: 761 - protein, 32 aa, Artificial Sequence
  VH Framework 3 (FR3)
RVTISVDTSKNQVSFKLSSVQAADTAVYYCAR

SEQ ID NO: 762 - protein, 32 aa, Artificial Sequence
  VH Framework 3 (FR3)
RVTISVDTSKNQVSFKLSSVTAQDTAVYYCAR

SEQ ID NO: 763 - protein, 32 aa, Artificial Sequence
  VH Framework 3 (FR3)
RVTISVDTSKNQVSLKMSSLTAADTAVYYCAR

SEQ ID NO: 764 - protein, 32 aa, Artificial Sequence
  VH Framework 3 (FR3)
RVTISVDTSKNQVSLKMSSVQAADTAVYYCAR

SEQ ID NO: 765 - protein, 32 aa, Artificial Sequence
  VH Framework 3 (FR3)
RVTISVDTSKNQVSLKMSSVTAQDTAVYYCAR

SEQ ID NO: 766 - protein, 32 aa, Artificial Sequence
  VH Framework 3 (FR3)
RVTISVDTSKNQVSLKLSSLQAADTAVYYCAR

SEQ ID NO: 767 - protein, 32 aa, Artificial Sequence
  VH Framework 3 (FR3)
RVTISVDTSKNQVSLKLSSLTAQDTAVYYCAR

SEQ ID NO: 768 - protein, 32 aa, Artificial Sequence
  VH Framework 3 (FR3)
RVTISVDTSKNQVSLKLSSVQAQDTAVYYCAR

SEQ ID NO: 769 - protein, 32 aa, Artificial Sequence
  VH Framework 3 (FR3)
RVTISVDTSKNQFSFKMSSLTAADTAVYYCAR

SEQ ID NO: 770 - protein, 32 aa, Artificial Sequence
  VH Framework 3 (FR3)
RVTISVDTSKNQFSFKMSSVQAADTAVYYCAR

SEQ ID NO: 771 - protein, 32 aa, Artificial Sequence
  VH Framework 3 (FR3)
RVTISVDTSKNQFSFKMSSVTAQDTAVYYCAR

SEQ ID NO: 772 - protein, 32 aa, Artificial Sequence
  VH Framework 3 (FR3)
RVTISVDTSKNQFSFKLSSLQAADTAVYYCAR

SEQ ID NO: 773 - protein, 32 aa, Artificial Sequence
  VH Framework 3 (FR3)
RVTISVDTSKNQFSFKLSSLTAQDTAVYYCAR

SEQ ID NO: 774 - protein, 32 aa, Artificial Sequence
  VH Framework 3 (FR3)
RVTISVDTSKNQFSFKLSSVQAQDTAVYYCAR

SEQ ID NO: 775 - protein, 32 aa, Artificial Sequence
  VH Framework 3 (FR3)
RVTISVDTSKNQFSLKMSSLQAADTAVYYCAR

SEQ ID NO: 776 - protein, 32 aa, Artificial Sequence
  VH Framework 3 (FR3)
RVTISVDTSKNQFSLKMSSLTAQDTAVYYCAR

SEQ ID NO: 777 - protein, 32 aa, Artificial Sequence
  VH Framework 3 (FR3)
RVTISVDTSKNQFSLKMSSVQAQDTAVYYCAR

SEQ ID NO: 778 - protein, 32 aa, Artificial Sequence
  VH Framework 3 (FR3)
RVTISVDTSKNQFSLKLSSLQAQDTAVYYCAR

SEQ ID NO: 779 - protein, 32 aa, Artificial Sequence
  VH Framework 3 (FR3)
RLTISKDNSKSQFSLKLSSVTAADTAVYYCAR

SEQ ID NO: 780 - protein, 32 aa, Artificial Sequence
  VH Framework 3 (FR3)
RLTISKDNSKNQVSLKLSSVTAADTAVYYCAR

SEQ ID NO: 781 - protein, 32 aa, Artificial Sequence
  VH Framework 3 (FR3)
RLTISKDNSKNQFSFKLSSVTAADTAVYYCAR

SEQ ID NO: 782 - protein, 32 aa, Artificial Sequence
  VH Framework 3 (FR3)
RLTISKDNSKNQFSLKMSSVTAADTAVYYCAR

SEQ ID NO: 783 - protein, 32 aa, Artificial Sequence
  VH Framework 3 (FR3)
RLTISKDNSKNQFSLKLSSLTAADTAVYYCAR

SEQ ID NO: 784 - protein, 32 aa, Artificial Sequence
  VH Framework 3 (FR3)
RLTISKDNSKNQFSLKLSSVQAADTAVYYCAR

SEQ ID NO: 785 - protein, 32 aa, Artificial Sequence
  VH Framework 3 (FR3)
RLTISKDNSKNQFSLKLSSVTAQDTAVYYCAR

SEQ ID NO: 786 - protein, 32 aa, Artificial Sequence
  VH Framework 3 (FR3)
RLTISKDTSKSQVSLKLSSVTAADTAVYYCAR

SEQ ID NO: 787 - protein, 32 aa, Artificial Sequence
  VH Framework 3 (FR3)
RLTISKDTSKSQFSFKLSSVTAADTAVYYCAR

SEQ ID NO: 788 - protein, 32 aa, Artificial Sequence
  VH Framework 3 (FR3)
RLTISKDTSKSQFSLKMSSVTAADTAVYYCAR

SEQ ID NO: 789 - protein, 32 aa, Artificial Sequence
  VH Framework 3 (FR3)
RLTISKDTSKSQFSLKLSSLTAADTAVYYCAR

SEQ ID NO: 790 - protein, 32 aa, Artificial Sequence
  VH Framework 3 (FR3)
RLTISKDTSKSQFSLKLSSVQAADTAVYYCAR

SEQ ID NO: 791 - protein, 32 aa, Artificial Sequence
  VH Framework 3 (FR3)
RLTISKDTSKSQFSLKLSSVTAQDTAVYYCAR

SEQ ID NO: 792 - protein, 32 aa, Artificial Sequence
  VH Framework 3 (FR3)
RLTISKDTSKNQVSFKLSSVTAADTAVYYCAR

SEQ ID NO: 793 - protein, 32 aa, Artificial Sequence
  VH Framework 3 (FR3)
RLTISKDTSKNQVSLKMSSVTAADTAVYYCAR

SEQ ID NO: 794 - protein, 32 aa, Artificial Sequence
  VH Framework 3 (FR3)
RLTISKDTSKNQVSLKLSSLTAADTAVYYCAR

SEQ ID NO: 795 - protein, 32 aa, Artificial Sequence
  VH Framework 3 (FR3)
RLTISKDTSKNQVSLKLSSVQAADTAVYYCAR

SEQ ID NO: 796 - protein, 32 aa, Artificial Sequence
  VH Framework 3 (FR3)
RLTISKDTSKNQVSLKLSSVTAQDTAVYYCAR

SEQ ID NO: 797 - protein, 32 aa, Artificial Sequence
  VH Framework 3 (FR3)
RLTISKDTSKNQFSFKMSSVTAADTAVYYCAR

SEQ ID NO: 798 - protein, 32 aa, Artificial Sequence
  VH Framework 3 (FR3)
RLTISKDTSKNQFSFKLSSLTAADTAVYYCAR

SEQ ID NO: 799 - protein, 32 aa, Artificial Sequence
  VH Framework 3 (FR3)
RLTISKDTSKNQFSFKLSSVQAADTAVYYCAR

SEQ ID NO: 800 - protein, 32 aa, Artificial Sequence
  VH Framework 3 (FR3)
RLTISKDTSKNQFSFKLSSVTAQDTAVYYCAR

SEQ ID NO: 801 - protein, 32 aa, Artificial Sequence
  VH Framework 3 (FR3)
RLTISKDTSKNQFSLKMSSLTAADTAVYYCAR

SEQ ID NO: 802 - protein, 32 aa, Artificial Sequence
  VH Framework 3 (FR3)
RLTISKDTSKNQFSLKMSSVQAADTAVYYCAR

SEQ ID NO: 803 - protein, 32 aa, Artificial Sequence
  VH Framework 3 (FR3)
RLTISKDTSKNQFSLKMSSVTAQDTAVYYCAR

SEQ ID NO: 804 - protein, 32 aa, Artificial Sequence
  VH Framework 3 (FR3)
RLTISKDTSKNQFSLKLSSLQAADTAVYYCAR

SEQ ID NO: 805 - protein, 32 aa, Artificial Sequence
  VH Framework 3 (FR3)
RLTISKDTSKNQFSLKLSSLTAQDTAVYYCAR

SEQ ID NO: 806 - protein, 32 aa, Artificial Sequence
  VH Framework 3 (FR3)
RLTISKDTSKNQFSLKLSSVQAQDTAVYYCAR

SEQ ID NO: 807 - protein, 32 aa, Artificial Sequence
  VH Framework 3 (FR3)
RLTISVDNSKSQVSLKLSSVTAADTAVYYCAR

SEQ ID NO: 808 - protein, 32 aa, Artificial Sequence
  VH Framework 3 (FR3)
RLTISVDNSKSQFSFKLSSVTAADTAVYYCAR

SEQ ID NO: 809 - protein, 32 aa, Artificial Sequence
  VH Framework 3 (FR3)
RLTISVDNSKSQFSLKMSSVTAADTAVYYCAR

SEQ ID NO: 810 - protein, 32 aa, Artificial Sequence
  VH Framework 3 (FR3)
RLTISVDNSKSQFSLKLSSLTAADTAVYYCAR

SEQ ID NO: 811 - protein, 32 aa, Artificial Sequence
  VH Framework 3 (FR3)
RLTISVDNSKSQFSLKLSSVQAADTAVYYCAR

SEQ ID NO: 812 - protein, 32 aa, Artificial Sequence
  VH Framework 3 (FR3)
RLTISVDNSKSQFSLKLSSVTAQDTAVYYCAR

SEQ ID NO: 813 - protein, 32 aa, Artificial Sequence
  VH Framework 3 (FR3)
RLTISVDNSKNQVSFKLSSVTAADTAVYYCAR

SEQ ID NO: 814 - protein, 32 aa, Artificial Sequence
  VH Framework 3 (FR3)
RLTISVDNSKNQVSLKMSSVTAADTAVYYCAR

SEQ ID NO: 815 - protein, 32 aa, Artificial Sequence
  VH Framework 3 (FR3)
RLTISVDNSKNQVSLKLSSLTAADTAVYYCAR

SEQ ID NO: 816 - protein, 32 aa, Artificial Sequence
  VH Framework 3 (FR3)
RLTISVDNSKNQVSLKLSSVQAADTAVYYCAR

SEQ ID NO: 817 - protein, 32 aa, Artificial Sequence
  VH Framework 3 (FR3)
RLTISVDNSKNQVSLKLSSVTAQDTAVYYCAR

SEQ ID NO: 818 - protein, 32 aa, Artificial Sequence
  VH Framework 3 (FR3)
RLTISVDNSKNQFSFKMSSVTAADTAVYYCAR

SEQ ID NO: 819 - protein, 32 aa, Artificial Sequence
  VH Framework 3 (FR3)
RLTISVDNSKNQFSFKLSSLTAADTAVYYCAR

SEQ ID NO: 820 - protein, 32 aa, Artificial Sequence
  VH Framework 3 (FR3)
RLTISVDNSKNQFSFKLSSVQAADTAVYYCAR

SEQ ID NO: 821 - protein, 32 aa, Artificial Sequence
  VH Framework 3 (FR3)
RLTISVDNSKNQFSFKLSSVTAQDTAVYYCAR

SEQ ID NO: 822 - protein, 32 aa, Artificial Sequence
  VH Framework 3 (FR3)
RLTISVDNSKNQFSLKMSSLTAADTAVYYCAR

SEQ ID NO: 823 - protein, 32 aa, Artificial Sequence
  VH Framework 3 (FR3)
RLTISVDNSKNQFSLKMSSVQAADTAVYYCAR

SEQ ID NO: 824 - protein, 32 aa, Artificial Sequence
  VH Framework 3 (FR3)
RLTISVDNSKNQFSLKMSSVTAQDTAVYYCAR

SEQ ID NO: 825 - protein, 32 aa, Artificial Sequence
  VH Framework 3 (FR3)
RLTISVDNSKNQFSLKLSSLQAADTAVYYCAR

SEQ ID NO: 826 - protein, 32 aa, Artificial Sequence
  VH Framework 3 (FR3)
RLTISVDNSKNQFSLKLSSLTAQDTAVYYCAR

SEQ ID NO: 827 - protein, 32 aa, Artificial Sequence
  VH Framework 3 (FR3)
RLTISVDNSKNQFSLKLSSVQAQDTAVYYCAR

SEQ ID NO: 828 - protein, 32 aa, Artificial Sequence
  VH Framework 3 (FR3)
RLTISVDTSKSQVSFKLSSVTAADTAVYYCAR

SEQ ID NO: 829 - protein, 32 aa, Artificial Sequence
  VH Framework 3 (FR3)
RLTISVDTSKSQVSLKMSSVTAADTAVYYCAR

SEQ ID NO: 830 - protein, 32 aa, Artificial Sequence
  VH Framework 3 (FR3)
RLTISVDTSKSQVSLKLSSLTAADTAVYYCAR

SEQ ID NO: 831 - protein, 32 aa, Artificial Sequence
  VH Framework 3 (FR3)
RLTISVDTSKSQVSLKLSSVQAADTAVYYCAR

SEQ ID NO: 832 - protein, 32 aa, Artificial Sequence
  VH Framework 3 (FR3)
RLTISVDTSKSQVSLKLSSVTAQDTAVYYCAR

SEQ ID NO: 833 - protein, 32 aa, Artificial Sequence
  VH Framework 3 (FR3)
RLTISVDTSKSQFSFKMSSVTAADTAVYYCAR

SEQ ID NO: 834 - protein, 32 aa, Artificial Sequence
  VH Framework 3 (FR3)
RLTISVDTSKSQFSFKLSSLTAADTAVYYCAR

SEQ ID NO: 835 - protein, 32 aa, Artificial Sequence
  VH Framework 3 (FR3)
RLTISVDTSKSQFSFKLSSVQAADTAVYYCAR

SEQ ID NO: 836 - protein, 32 aa, Artificial Sequence
  VH Framework 3 (FR3)
RLTISVDTSKSQFSFKLSSVTAQDTAVYYCAR

SEQ ID NO: 837 - protein, 32 aa, Artificial Sequence
  VH Framework 3 (FR3)
RLTISVDTSKSQFSLKMSSLTAADTAVYYCAR

SEQ ID NO: 838 - protein, 32 aa, Artificial Sequence
  VH Framework 3 (FR3)
RLTISVDTSKSQFSLKMSSVQAADTAVYYCAR

SEQ ID NO: 839 - protein, 32 aa, Artificial Sequence
  VH Framework 3 (FR3)
RLTISVDTSKSQFSLKMSSVTAQDTAVYYCAR

SEQ ID NO: 840 - protein, 32 aa, Artificial Sequence
  VH Framework 3 (FR3)
RLTISVDTSKSQFSLKLSSLQAADTAVYYCAR

SEQ ID NO: 841 - protein, 32 aa, Artificial Sequence
  VH Framework 3 (FR3)
RLTISVDTSKSQFSLKLSSLTAQDTAVYYCAR

SEQ ID NO: 842 - protein, 32 aa, Artificial Sequence
  VH Framework 3 (FR3)
RLTISVDTSKSQFSLKLSSVQAQDTAVYYCAR

SEQ ID NO: 843 - protein, 32 aa, Artificial Sequence
  VH Framework 3 (FR3)
RLTISVDTSKNQVSFKMSSVTAADTAVYYCAR

SEQ ID NO: 844 - protein, 32 aa, Artificial Sequence
  VH Framework 3 (FR3)
RLTISVDTSKNQVSFKLSSLTAADTAVYYCAR

SEQ ID NO: 845 - protein, 32 aa, Artificial Sequence
  VH Framework 3 (FR3)
RLTISVDTSKNQVSFKLSSVQAADTAVYYCAR

SEQ ID NO: 846 - protein, 32 aa, Artificial Sequence
  VH Framework 3 (FR3)
RLTISVDTSKNQVSFKLSSVTAQDTAVYYCAR

SEQ ID NO: 847 - protein, 32 aa, Artificial Sequence
  VH Framework 3 (FR3)
RLTISVDTSKNQVSLKMSSLTAADTAVYYCAR

SEQ ID NO: 848 - protein, 32 aa, Artificial Sequence
  VH Framework 3 (FR3)
RLTISVDTSKNQVSLKMSSVQAADTAVYYCAR

SEQ ID NO: 849 - protein, 32 aa, Artificial Sequence
  VH Framework 3 (FR3)
RLTISVDTSKNQVSLKMSSVTAQDTAVYYCAR

SEQ ID NO: 850 - protein, 32 aa, Artificial Sequence
  VH Framework 3 (FR3)
RLTISVDTSKNQVSLKLSSLQAADTAVYYCAR

SEQ ID NO: 851 - protein, 32 aa, Artificial Sequence
  VH Framework 3 (FR3)
RLTISVDTSKNQVSLKLSSLTAQDTAVYYCAR

SEQ ID NO: 852 - protein, 32 aa, Artificial Sequence
  VH Framework 3 (FR3)
RLTISVDTSKNQVSLKLSSVQAQDTAVYYCAR

SEQ ID NO: 853 - protein, 32 aa, Artificial Sequence
  VH Framework 3 (FR3)
RLTISVDTSKNQFSFKMSSLTAADTAVYYCAR

SEQ ID NO: 854 - protein, 32 aa, Artificial Sequence
  VH Framework 3 (FR3)
RLTISVDTSKNQFSFKMSSVQAADTAVYYCAR

SEQ ID NO: 855 - protein, 32 aa, Artificial Sequence
  VH Framework 3 (FR3)
RLTISVDTSKNQFSFKMSSVTAQDTAVYYCAR

SEQ ID NO: 856 - protein, 32 aa, Artificial Sequence
  VH Framework 3 (FR3)
RLTISVDTSKNQFSFKLSSLQAADTAVYYCAR

SEQ ID NO: 857 - protein, 32 aa, Artificial Sequence
  VH Framework 3 (FR3)
RLTISVDTSKNQFSFKLSSLTAQDTAVYYCAR

SEQ ID NO: 858 - protein, 32 aa, Artificial Sequence
  VH Framework 3 (FR3)
RLTISVDTSKNQFSFKLSSVQAQDTAVYYCAR

SEQ ID NO: 859 - protein, 32 aa, Artificial Sequence
  VH Framework 3 (FR3)
RLTISVDTSKNQFSLKMSSLQAADTAVYYCAR

SEQ ID NO: 860 - protein, 32 aa, Artificial Sequence
  VH Framework 3 (FR3)
RLTISVDTSKNQFSLKMSSLTAQDTAVYYCAR

SEQ ID NO: 861 - protein, 32 aa, Artificial Sequence
  VH Framework 3 (FR3)
RLTISVDTSKNQFSLKMSSVQAQDTAVYYCAR

SEQ ID NO: 862 - protein, 32 aa, Artificial Sequence
  VH Framework 3 (FR3)
RLTISVDTSKNQFSLKLSSLQAQDTAVYYCAR

SEQ ID NO: 863 - protein, 32 aa, Artificial Sequence
  VH Framework 3 (FR3)
RVTISKDNSKSQVSLKLSSVTAADTAVYYCAR

SEQ ID NO: 864 - protein, 32 aa, Artificial Sequence
  VH Framework 3 (FR3)
RVTISKDNSKSQFSFKLSSVTAADTAVYYCAR

SEQ ID NO: 865 - protein, 32 aa, Artificial Sequence
  VH Framework 3 (FR3)
RVTISKDNSKSQFSLKMSSVTAADTAVYYCAR

SEQ ID NO: 866 - protein, 32 aa, Artificial Sequence
  VH Framework 3 (FR3)
RVTISKDNSKSQFSLKLSSLTAADTAVYYCAR

SEQ ID NO: 867 - protein, 32 aa, Artificial Sequence
  VH Framework 3 (FR3)
RVTISKDNSKSQFSLKLSSVQAADTAVYYCAR

SEQ ID NO: 868 - protein, 32 aa, Artificial Sequence
  VH Framework 3 (FR3)
RVTISKDNSKSQFSLKLSSVTAQDTAVYYCAR

SEQ ID NO: 869 - protein, 32 aa, Artificial Sequence
  VH Framework 3 (FR3)
RVTISKDNSKNQVSFKLSSVTAADTAVYYCAR

SEQ ID NO: 870 - protein, 32 aa, Artificial Sequence
  VH Framework 3 (FR3)
RVTISKDNSKNQVSLKMSSVTAADTAVYYCAR

SEQ ID NO: 871 - protein, 32 aa, Artificial Sequence
  VH Framework 3 (FR3)
RVTISKDNSKNQVSLKLSSLTAADTAVYYCAR

SEQ ID NO: 872 - protein, 32 aa, Artificial Sequence
  VH Framework 3 (FR3)
RVTISKDNSKNQVSLKLSSVQAADTAVYYCAR

SEQ ID NO: 873 - protein, 32 aa, Artificial Sequence
  VH Framework 3 (FR3)
RVTISKDNSKNQVSLKLSSVTAQDTAVYYCAR

SEQ ID NO: 874 - protein, 32 aa, Artificial Sequence
  VH Framework 3 (FR3)
RVTISKDNSKNQFSFKMSSVTAADTAVYYCAR

SEQ ID NO: 875 - protein, 32 aa, Artificial Sequence
  VH Framework 3 (FR3)
RVTISKDNSKNQFSFKLSSLTAADTAVYYCAR

SEQ ID NO: 876 - protein, 32 aa, Artificial Sequence
  VH Framework 3 (FR3)
RVTISKDNSKNQFSFKLSSVQAADTAVYYCAR

SEQ ID NO: 877 - protein, 32 aa, Artificial Sequence
  VH Framework 3 (FR3)
RVTISKDNSKNQFSFKLSSVTAQDTAVYYCAR

SEQ ID NO: 878 - protein, 32 aa, Artificial Sequence
  VH Framework 3 (FR3)
RVTISKDNSKNQFSLKMSSLTAADTAVYYCAR

SEQ ID NO: 879 - protein, 32 aa, Artificial Sequence
  VH Framework 3 (FR3)
RVTISKDNSKNQFSLKMSSVQAADTAVYYCAR

SEQ ID NO: 880 - protein, 32 aa, Artificial Sequence
  VH Framework 3 (FR3)
RVTISKDNSKNQFSLKMSSVTAQDTAVYYCAR

SEQ ID NO: 881 - protein, 32 aa, Artificial Sequence
  VH Framework 3 (FR3)
RVTISKDNSKNQFSLKLSSLQAADTAVYYCAR

SEQ ID NO: 882 - protein, 32 aa, Artificial Sequence
  VH Framework 3 (FR3)
RVTISKDNSKNQFSLKLSSLTAQDTAVYYCAR

SEQ ID NO: 883 - protein, 32 aa, Artificial Sequence
  VH Framework 3 (FR3)
RVTISKDNSKNQFSLKLSSVQAQDTAVYYCAR

SEQ ID NO: 884 - protein, 32 aa, Artificial Sequence
  VH Framework 3 (FR3)
RVTISKDTSKSQVSFKLSSVTAADTAVYYCAR

SEQ ID NO: 885 - protein, 32 aa, Artificial Sequence
  VH Framework 3 (FR3)
RVTISKDTSKSQVSLKMSSVTAADTAVYYCAR

SEQ ID NO: 886 - protein, 32 aa, Artificial Sequence
  VH Framework 3 (FR3)
RVTISKDTSKSQVSLKLSSLTAADTAVYYCAR

SEQ ID NO: 887 - protein, 32 aa, Artificial Sequence
  VH Framework 3 (FR3)
RVTISKDTSKSQVSLKLSSVQAADTAVYYCAR

SEQ ID NO: 888 - protein, 32 aa, Artificial Sequence
  VH Framework 3 (FR3)
RVTISKDTSKSQVSLKLSSVTAQDTAVYYCAR

SEQ ID NO: 889 - protein, 32 aa, Artificial Sequence
  VH Framework 3 (FR3)
RVTISKDTSKSQFSFKMSSVTAADTAVYYCAR

SEQ ID NO: 890 - protein, 32 aa, Artificial Sequence
  VH Framework 3 (FR3)
RVTISKDTSKSQFSFKLSSLTAADTAVYYCAR

SEQ ID NO: 891 - protein, 32 aa, Artificial Sequence
  VH Framework 3 (FR3)
RVTISKDTSKSQFSFKLSSVQAADTAVYYCAR

SEQ ID NO: 892 - protein, 32 aa, Artificial Sequence
  VH Framework 3 (FR3)
RVTISKDTSKSQFSFKLSSVTAQDTAVYYCAR

SEQ ID NO: 893 - protein, 32 aa, Artificial Sequence
  VH Framework 3 (FR3)
RVTISKDTSKSQFSLKMSSLTAADTAVYYCAR

SEQ ID NO: 894 - protein, 32 aa, Artificial Sequence
  VH Framework 3 (FR3)
RVTISKDTSKSQFSLKMSSVQAADTAVYYCAR

SEQ ID NO: 895 - protein, 32 aa, Artificial Sequence
  VH Framework 3 (FR3)
RVTISKDTSKSQFSLKMSSVTAQDTAVYYCAR

SEQ ID NO: 896 - protein, 32 aa, Artificial Sequence
  VH Framework 3 (FR3)
RVTISKDTSKSQFSLKLSSLQAADTAVYYCAR

SEQ ID NO: 897 - protein, 32 aa, Artificial Sequence
  VH Framework 3 (FR3)
RVTISKDTSKSQFSLKLSSLTAQDTAVYYCAR

SEQ ID NO: 898 - protein, 32 aa, Artificial Sequence
  VH Framework 3 (FR3)
RVTISKDTSKSQFSLKLSSVQAQDTAVYYCAR

SEQ ID NO: 899 - protein, 32 aa, Artificial Sequence
  VH Framework 3 (FR3)
RVTISKDTSKNQVSFKMSSVTAADTAVYYCAR

SEQ ID NO: 900 - protein, 32 aa, Artificial Sequence
  VH Framework 3 (FR3)
RVTISKDTSKNQVSFKLSSLTAADTAVYYCAR

SEQ ID NO: 901 - protein, 32 aa, Artificial Sequence
  VH Framework 3 (FR3)
RVTISKDTSKNQVSFKLSSVQAADTAVYYCAR

SEQ ID NO: 902 - protein, 32 aa, Artificial Sequence
  VH Framework 3 (FR3)
RVTISKDTSKNQVSFKLSSVTAQDTAVYYCAR

SEQ ID NO: 903 - protein, 32 aa, Artificial Sequence
  VH Framework 3 (FR3)
RVTISKDTSKNQVSLKMSSLTAADTAVYYCAR

SEQ ID NO: 904 - protein, 32 aa, Artificial Sequence
  VH Framework 3 (FR3)
RVTISKDTSKNQVSLKMSSVQAADTAVYYCAR

SEQ ID NO: 905 - protein, 32 aa, Artificial Sequence
  VH Framework 3 (FR3)
RVTISKDTSKNQVSLKMSSVTAQDTAVYYCAR

SEQ ID NO: 906 - protein, 32 aa, Artificial Sequence
  VH Framework 3 (FR3)
RVTISKDTSKNQVSLKLSSLQAADTAVYYCAR

SEQ ID NO: 907 - protein, 32 aa, Artificial Sequence
  VH Framework 3 (FR3)
RVTISKDTSKNQVSLKLSSLTAQDTAVYYCAR

SEQ ID NO: 908 - protein, 32 aa, Artificial Sequence
  VH Framework 3 (FR3)
RVTISKDTSKNQVSLKLSSVQAQDTAVYYCAR

SEQ ID NO: 909 - protein, 32 aa, Artificial Sequence
  VH Framework 3 (FR3)
RVTISKDTSKNQFSFKMSSLTAADTAVYYCAR

SEQ ID NO: 910 - protein, 32 aa, Artificial Sequence
  VH Framework 3 (FR3)
RVTISKDTSKNQFSFKMSSVQAADTAVYYCAR

SEQ ID NO: 911 - protein, 32 aa, Artificial Sequence
  VH Framework 3 (FR3)
RVTISKDTSKNQFSFKMSSVTAQDTAVYYCAR

SEQ ID NO: 912 - protein, 32 aa, Artificial Sequence
  VH Framework 3 (FR3)
RVTISKDTSKNQFSFKLSSLQAADTAVYYCAR

SEQ ID NO: 913 - protein, 32 aa, Artificial Sequence
  VH Framework 3 (FR3)
RVTISKDTSKNQFSFKLSSLTAQDTAVYYCAR

SEQ ID NO: 914 - protein, 32 aa, Artificial Sequence
  VH Framework 3 (FR3)
RVTISKDTSKNQFSFKLSSVQAQDTAVYYCAR

SEQ ID NO: 915 - protein, 32 aa, Artificial Sequence
  VH Framework 3 (FR3)
RVTISKDTSKNQFSLKMSSLQAADTAVYYCAR

SEQ ID NO: 916 - protein, 32 aa, Artificial Sequence
  VH Framework 3 (FR3)
RVTISKDTSKNQFSLKMSSLTAQDTAVYYCAR

SEQ ID NO: 917 - protein, 32 aa, Artificial Sequence
  VH Framework 3 (FR3)
RVTISKDTSKNQFSLKMSSVQAQDTAVYYCAR

SEQ ID NO: 918 - protein, 32 aa, Artificial Sequence
  VH Framework 3 (FR3)
RVTISKDTSKNQFSLKLSSLQAQDTAVYYCAR

SEQ ID NO: 919 - protein, 32 aa, Artificial Sequence
  VH Framework 3 (FR3)
RVTISVDNSKSQVSFKLSSVTAADTAVYYCAR

SEQ ID NO: 920 - protein, 32 aa, Artificial Sequence
  VH Framework 3 (FR3)
RVTISVDNSKSQVSLKMSSVTAADTAVYYCAR

SEQ ID NO: 921 - protein, 32 aa, Artificial Sequence
  VH Framework 3 (FR3)
RVTISVDNSKSQVSLKLSSLTAADTAVYYCAR

SEQ ID NO: 922 - protein, 32 aa, Artificial Sequence
  VH Framework 3 (FR3)
RVTISVDNSKSQVSLKLSSVQAADTAVYYCAR

SEQ ID NO: 923 - protein, 32 aa, Artificial Sequence
  VH Framework 3 (FR3)
RVTISVDNSKSQVSLKLSSVTAQDTAVYYCAR

SEQ ID NO: 924 - protein, 32 aa, Artificial Sequence
  VH Framework 3 (FR3)
RVTISVDNSKSQFSFKMSSVTAADTAVYYCAR

SEQ ID NO: 925 - protein, 32 aa, Artificial Sequence
  VH Framework 3 (FR3)
RVTISVDNSKSQFSFKLSSLTAADTAVYYCAR

SEQ ID NO: 926 - protein, 32 aa, Artificial Sequence
  VH Framework 3 (FR3)
RVTISVDNSKSQFSFKLSSVQAADTAVYYCAR

SEQ ID NO: 927 - protein, 32 aa, Artificial Sequence
  VH Framework 3 (FR3)
RVTISVDNSKSQFSFKLSSVTAQDTAVYYCAR

SEQ ID NO: 928 - protein, 32 aa, Artificial Sequence
  VH Framework 3 (FR3)
RVTISVDNSKSQFSLKMSSLTAADTAVYYCAR

SEQ ID NO: 929 - protein, 32 aa, Artificial Sequence
  VH Framework 3 (FR3)
RVTISVDNSKSQFSLKMSSVQAADTAVYYCAR

SEQ ID NO: 930 - protein, 32 aa, Artificial Sequence
  VH Framework 3 (FR3)
RVTISVDNSKSQFSLKMSSVTAQDTAVYYCAR

SEQ ID NO: 931 - protein, 32 aa, Artificial Sequence
  VH Framework 3 (FR3)
RVTISVDNSKSQFSLKLSSLQAADTAVYYCAR

SEQ ID NO: 932 - protein, 32 aa, Artificial Sequence
  VH Framework 3 (FR3)
RVTISVDNSKSQFSLKLSSLTAQDTAVYYCAR

SEQ ID NO: 933 - protein, 32 aa, Artificial Sequence
  VH Framework 3 (FR3)
RVTISVDNSKSQFSLKLSSVQAQDTAVYYCAR

SEQ ID NO: 934 - protein, 32 aa, Artificial Sequence
  VH Framework 3 (FR3)
RVTISVDNSKNQVSFKMSSVTAADTAVYYCAR

SEQ ID NO: 935 - protein, 32 aa, Artificial Sequence
  VH Framework 3 (FR3)
RVTISVDNSKNQVSFKLSSLTAADTAVYYCAR

SEQ ID NO: 936 - protein, 32 aa, Artificial Sequence
  VH Framework 3 (FR3)
RVTISVDNSKNQVSFKLSSVQAADTAVYYCAR

SEQ ID NO: 937 - protein, 32 aa, Artificial Sequence
  VH Framework 3 (FR3)
RVTISVDNSKNQVSFKLSSVTAQDTAVYYCAR

SEQ ID NO: 938 - protein, 32 aa, Artificial Sequence
  VH Framework 3 (FR3)
RVTISVDNSKNQVSLKMSSLTAADTAVYYCAR

SEQ ID NO: 939 - protein, 32 aa, Artificial Sequence
  VH Framework 3 (FR3)
RVTISVDNSKNQVSLKMSSVQAADTAVYYCAR

SEQ ID NO: 940 - protein, 32 aa, Artificial Sequence
  VH Framework 3 (FR3)
RVTISVDNSKNQVSLKMSSVTAQDTAVYYCAR

SEQ ID NO: 941 - protein, 32 aa, Artificial Sequence
  VH Framework 3 (FR3)
RVTISVDNSKNQVSLKLSSLQAADTAVYYCAR

SEQ ID NO: 942 - protein, 32 aa, Artificial Sequence
  VH Framework 3 (FR3)
RVTISVDNSKNQVSLKLSSLTAQDTAVYYCAR

SEQ ID NO: 943 - protein, 32 aa, Artificial Sequence
  VH Framework 3 (FR3)
RVTISVDNSKNQVSLKLSSVQAQDTAVYYCAR

SEQ ID NO: 944 - protein, 32 aa, Artificial Sequence
  VH Framework 3 (FR3)
RVTISVDNSKNQFSFKMSSLTAADTAVYYCAR

SEQ ID NO: 945 - protein, 32 aa, Artificial Sequence
  VH Framework 3 (FR3)
RVTISVDNSKNQFSFKMSSVQAADTAVYYCAR

SEQ ID NO: 946 - protein, 32 aa, Artificial Sequence
  VH Framework 3 (FR3)
RVTISVDNSKNQFSFKMSSVTAQDTAVYYCAR

SEQ ID NO: 947 - protein, 32 aa, Artificial Sequence
  VH Framework 3 (FR3)
RVTISVDNSKNQFSFKLSSLQAADTAVYYCAR

SEQ ID NO: 948 - protein, 32 aa, Artificial Sequence
  VH Framework 3 (FR3)
RVTISVDNSKNQFSFKLSSLTAQDTAVYYCAR

SEQ ID NO: 949 - protein, 32 aa, Artificial Sequence
  VH Framework 3 (FR3)
RVTISVDNSKNQFSFKLSSVQAQDTAVYYCAR

SEQ ID NO: 950 - protein, 32 aa, Artificial Sequence
  VH Framework 3 (FR3)
RVTISVDNSKNQFSLKMSSLQAADTAVYYCAR

SEQ ID NO: 951 - protein, 32 aa, Artificial Sequence
  VH Framework 3 (FR3)
RVTISVDNSKNQFSLKMSSLTAQDTAVYYCAR

SEQ ID NO: 952 - protein, 32 aa, Artificial Sequence
  VH Framework 3 (FR3)
RVTISVDNSKNQFSLKMSSVQAQDTAVYYCAR

SEQ ID NO: 953 - protein, 32 aa, Artificial Sequence
  VH Framework 3 (FR3)
RVTISVDNSKNQFSLKLSSLQAQDTAVYYCAR

SEQ ID NO: 954 - protein, 32 aa, Artificial Sequence
  VH Framework 3 (FR3)
RVTISVDTSKSQVSFKMSSVTAADTAVYYCAR

SEQ ID NO: 955 - protein, 32 aa, Artificial Sequence
  VH Framework 3 (FR3)
RVTISVDTSKSQVSFKLSSLTAADTAVYYCAR

SEQ ID NO: 956 - protein, 32 aa, Artificial Sequence
  VH Framework 3 (FR3)
RVTISVDTSKSQVSFKLSSVQAADTAVYYCAR

SEQ ID NO: 957 - protein, 32 aa, Artificial Sequence
  VH Framework 3 (FR3)
RVTISVDTSKSQVSFKLSSVTAQDTAVYYCAR

SEQ ID NO: 958 - protein, 32 aa, Artificial Sequence
  VH Framework 3 (FR3)
RVTISVDTSKSQVSLKMSSLTAADTAVYYCAR

SEQ ID NO: 959 - protein, 32 aa, Artificial Sequence
  VH Framework 3 (FR3)
RVTISVDTSKSQVSLKMSSVQAADTAVYYCAR

SEQ ID NO: 960 - protein, 32 aa, Artificial Sequence
  VH Framework 3 (FR3)
RVTISVDTSKSQVSLKMSSVTAQDTAVYYCAR

SEQ ID NO: 961 - protein, 32 aa, Artificial Sequence
  VH Framework 3 (FR3)
RVTISVDTSKSQVSLKLSSLQAADTAVYYCAR

SEQ ID NO: 962 - protein, 32 aa, Artificial Sequence
  VH Framework 3 (FR3)
RVTISVDTSKSQVSLKLSSLTAQDTAVYYCAR

SEQ ID NO: 963 - protein, 32 aa, Artificial Sequence
  VH Framework 3 (FR3)
RVTISVDTSKSQVSLKLSSVQAQDTAVYYCAR

SEQ ID NO: 964 - protein, 32 aa, Artificial Sequence
  VH Framework 3 (FR3)
RVTISVDTSKSQFSFKMSSLTAADTAVYYCAR

SEQ ID NO: 965 - protein, 32 aa, Artificial Sequence
  VH Framework 3 (FR3)
RVTISVDTSKSQFSFKMSSVQAADTAVYYCAR

SEQ ID NO: 966 - protein, 32 aa, Artificial Sequence
  VH Framework 3 (FR3)
RVTISVDTSKSQFSFKMSSVTAQDTAVYYCAR

SEQ ID NO: 967 - protein, 32 aa, Artificial Sequence
  VH Framework 3 (FR3)
RVTISVDTSKSQFSFKLSSLQAADTAVYYCAR

SEQ ID NO: 968 - protein, 32 aa, Artificial Sequence
  VH Framework 3 (FR3)
RVTISVDTSKSQFSFKLSSLTAQDTAVYYCAR

SEQ ID NO: 969 - protein, 32 aa, Artificial Sequence
  VH Framework 3 (FR3)
RVTISVDTSKSQFSFKLSSVQAQDTAVYYCAR

SEQ ID NO: 970 - protein, 32 aa, Artificial Sequence
  VH Framework 3 (FR3)
RVTISVDTSKSQFSLKMSSLQAADTAVYYCAR

SEQ ID NO: 971 - protein, 32 aa, Artificial Sequence
  VH Framework 3 (FR3)
RVTISVDTSKSQFSLKMSSLTAQDTAVYYCAR

SEQ ID NO: 972 - protein, 32 aa, Artificial Sequence
  VH Framework 3 (FR3)
RVTISVDTSKSQFSLKMSSVQAQDTAVYYCAR

SEQ ID NO: 973 - protein, 32 aa, Artificial Sequence
  VH Framework 3 (FR3)
RVTISVDTSKSQFSLKLSSLQAQDTAVYYCAR

SEQ ID NO: 974 - protein, 32 aa, Artificial Sequence
  VH Framework 3 (FR3)
RVTISVDTSKNQVSFKMSSLTAADTAVYYCAR

SEQ ID NO: 975 - protein, 32 aa, Artificial Sequence
  VH Framework 3 (FR3)
RVTISVDTSKNQVSFKMSSVQAADTAVYYCAR

SEQ ID NO: 976 - protein, 32 aa, Artificial Sequence
  VH Framework 3 (FR3)
RVTISVDTSKNQVSFKMSSVTAQDTAVYYCAR

SEQ ID NO: 977 - protein, 32 aa, Artificial Sequence
  VH Framework 3 (FR3)
RVTISVDTSKNQVSFKLSSLQAADTAVYYCAR

SEQ ID NO: 978 - protein, 32 aa, Artificial Sequence
  VH Framework 3 (FR3)
RVTISVDTSKNQVSFKLSSLTAQDTAVYYCAR

SEQ ID NO: 979 - protein, 32 aa, Artificial Sequence
  VH Framework 3 (FR3)
RVTISVDTSKNQVSFKLSSVQAQDTAVYYCAR

SEQ ID NO: 980 - protein, 32 aa, Artificial Sequence
  VH Framework 3 (FR3)
RVTISVDTSKNQVSLKMSSLQAADTAVYYCAR

SEQ ID NO: 981 - protein, 32 aa, Artificial Sequence
  VH Framework 3 (FR3)
RVTISVDTSKNQVSLKMSSLTAQDTAVYYCAR

SEQ ID NO: 982 - protein, 32 aa, Artificial Sequence
  VH Framework 3 (FR3)
RVTISVDTSKNQVSLKMSSVQAQDTAVYYCAR

SEQ ID NO: 983 - protein, 32 aa, Artificial Sequence
  VH Framework 3 (FR3)
RVTISVDTSKNQVSLKLSSLQAQDTAVYYCAR

SEQ ID NO: 984 - protein, 32 aa, Artificial Sequence
  VH Framework 3 (FR3)
RVTISVDTSKNQFSFKMSSLQAADTAVYYCAR

SEQ ID NO: 985 - protein, 32 aa, Artificial Sequence
  VH Framework 3 (FR3)
RVTISVDTSKNQFSFKMSSLTAQDTAVYYCAR

SEQ ID NO: 986 - protein, 32 aa, Artificial Sequence
  VH Framework 3 (FR3)
RVTISVDTSKNQFSFKMSSVQAQDTAVYYCAR

SEQ ID NO: 987 - protein, 32 aa, Artificial Sequence
  VH Framework 3 (FR3)
RVTISVDTSKNQFSFKLSSLQAQDTAVYYCAR

SEQ ID NO: 988 - protein, 32 aa, Artificial Sequence
  VH Framework 3 (FR3)
RVTISVDTSKNQFSLKMSSLQAQDTAVYYCAR

SEQ ID NO: 989 - protein, 32 aa, Artificial Sequence
  VH Framework 3 (FR3)
RLTISKDNSKSQVSLKLSSVTAADTAVYYCAR

SEQ ID NO: 990 - protein, 32 aa, Artificial Sequence
  VH Framework 3 (FR3)
RLTISKDNSKSQFSFKLSSVTAADTAVYYCAR

SEQ ID NO: 991 - protein, 32 aa, Artificial Sequence
  VH Framework 3 (FR3)
RLTISKDNSKSQFSLKMSSVTAADTAVYYCAR

SEQ ID NO: 992 - protein, 32 aa, Artificial Sequence
  VH Framework 3 (FR3)
RLTISKDNSKSQFSLKLSSLTAADTAVYYCAR

SEQ ID NO: 993 - protein, 32 aa, Artificial Sequence
  VH Framework 3 (FR3)
RLTISKDNSKSQFSLKLSSVQAADTAVYYCAR

SEQ ID NO: 994 - protein, 32 aa, Artificial Sequence
  VH Framework 3 (FR3)
RLTISKDNSKSQFSLKLSSVTAQDTAVYYCAR

SEQ ID NO: 995 - protein, 32 aa, Artificial Sequence
  VH Framework 3 (FR3)
RLTISKDNSKNQVSFKLSSVTAADTAVYYCAR

SEQ ID NO: 996 - protein, 32 aa, Artificial Sequence
  VH Framework 3 (FR3)
RLTISKDNSKNQVSLKMSSVTAADTAVYYCAR

SEQ ID NO: 997 - protein, 32 aa, Artificial Sequence
  VH Framework 3 (FR3)
RLTISKDNSKNQVSLKLSSLTAADTAVYYCAR

SEQ ID NO: 998 - protein, 32 aa, Artificial Sequence
  VH Framework 3 (FR3)
RLTISKDNSKNQVSLKLSSVQAADTAVYYCAR

SEQ ID NO: 999 - protein, 32 aa, Artificial Sequence
  VH Framework 3 (FR3)
RLTISKDNSKNQVSLKLSSVTAQDTAVYYCAR

SEQ ID NO: 1000 - protein, 32 aa, Artificial Sequence
  VH Framework 3 (FR3)
RLTISKDNSKNQFSFKMSSVTAADTAVYYCAR

SEQ ID NO: 1001 - protein, 32 aa, Artificial Sequence
  VH Framework 3 (FR3)
RLTISKDNSKNQFSFKLSSLTAADTAVYYCAR

SEQ ID NO: 1002 - protein, 32 aa, Artificial Sequence
  VH Framework 3 (FR3)
RLTISKDNSKNQFSFKLSSVQAADTAVYYCAR

SEQ ID NO: 1003 - protein, 32 aa, Artificial Sequence
  VH Framework 3 (FR3)
RLTISKDNSKNQFSFKLSSVTAQDTAVYYCAR

SEQ ID NO: 1004 - protein, 32 aa, Artificial Sequence
  VH Framework 3 (FR3)
RLTISKDNSKNQFSLKMSSLTAADTAVYYCAR

SEQ ID NO: 1005 - protein, 32 aa, Artificial Sequence
  VH Framework 3 (FR3)
RLTISKDNSKNQFSLKMSSVQAADTAVYYCAR

SEQ ID NO: 1006 - protein, 32 aa, Artificial Sequence
  VH Framework 3 (FR3)
RLTISKDNSKNQFSLKMSSVTAQDTAVYYCAR

SEQ ID NO: 1007 - protein, 32 aa, Artificial Sequence
  VH Framework 3 (FR3)
RLTISKDNSKNQFSLKLSSLQAADTAVYYCAR

SEQ ID NO: 1008 - protein, 32 aa, Artificial Sequence
  VH Framework 3 (FR3)
RLTISKDNSKNQFSLKLSSLTAQDTAVYYCAR

SEQ ID NO: 1009 - protein, 32 aa, Artificial Sequence
  VH Framework 3 (FR3)
RLTISKDNSKNQFSLKLSSVQAQDTAVYYCAR

SEQ ID NO: 1010 - protein, 32 aa, Artificial Sequence
  VH Framework 3 (FR3)
RLTISKDTSKSQVSFKLSSVTAADTAVYYCAR

SEQ ID NO: 1011 - protein, 32 aa, Artificial Sequence
  VH Framework 3 (FR3)
RLTISKDTSKSQVSLKMSSVTAADTAVYYCAR

SEQ ID NO: 1012 - protein, 32 aa, Artificial Sequence
  VH Framework 3 (FR3)
RLTISKDTSKSQVSLKLSSLTAADTAVYYCAR

SEQ ID NO: 1013 - protein, 32 aa, Artificial Sequence
  VH Framework 3 (FR3)
RLTISKDTSKSQVSLKLSSVQAADTAVYYCAR

SEQ ID NO: 1014 - protein, 32 aa, Artificial Sequence
  VH Framework 3 (FR3)
RLTISKDTSKSQVSLKLSSVTAQDTAVYYCAR

SEQ ID NO: 1015 - protein, 32 aa, Artificial Sequence
  VH Framework 3 (FR3)
RLTISKDTSKSQFSFKMSSVTAADTAVYYCAR

SEQ ID NO: 1016 - protein, 32 aa, Artificial Sequence
  VH Framework 3 (FR3)
RLTISKDTSKSQFSFKLSSLTAADTAVYYCAR

SEQ ID NO: 1017 - protein, 32 aa, Artificial Sequence
  VH Framework 3 (FR3)
RLTISKDTSKSQFSFKLSSVQAADTAVYYCAR

SEQ ID NO: 1018 - protein, 32 aa, Artificial Sequence
  VH Framework 3 (FR3)
RLTISKDTSKSQFSFKLSSVTAQDTAVYYCAR

SEQ ID NO: 1019 - protein, 32 aa, Artificial Sequence
  VH Framework 3 (FR3)
RLTISKDTSKSQFSLKMSSLTAADTAVYYCAR

SEQ ID NO: 1020 - protein, 32 aa, Artificial Sequence
  VH Framework 3 (FR3)
RLTISKDTSKSQFSLKMSSVQAADTAVYYCAR

SEQ ID NO: 1021 - protein, 32 aa, Artificial Sequence
  VH Framework 3 (FR3)
RLTISKDTSKSQFSLKMSSVTAQDTAVYYCAR

SEQ ID NO: 1022 - protein, 32 aa, Artificial Sequence
  VH Framework 3 (FR3)
RLTISKDTSKSQFSLKLSSLQAADTAVYYCAR

SEQ ID NO: 1023 - protein, 32 aa, Artificial Sequence
  VH Framework 3 (FR3)
RLTISKDTSKSQFSLKLSSLTAQDTAVYYCAR

SEQ ID NO: 1024 - protein, 32 aa, Artificial Sequence
  VH Framework 3 (FR3)
RLTISKDTSKSQFSLKLSSVQAQDTAVYYCAR

SEQ ID NO: 1025 - protein, 32 aa, Artificial Sequence
  VH Framework 3 (FR3)
RLTISKDTSKNQVSFKMSSVTAADTAVYYCAR

SEQ ID NO: 1026 - protein, 32 aa, Artificial Sequence
  VH Framework 3 (FR3)
RLTISKDTSKNQVSFKLSSLTAADTAVYYCAR

SEQ ID NO: 1027 - protein, 32 aa, Artificial Sequence
  VH Framework 3 (FR3)
RLTISKDTSKNQVSFKLSSVQAADTAVYYCAR

SEQ ID NO: 1028 - protein, 32 aa, Artificial Sequence
  VH Framework 3 (FR3)
RLTISKDTSKNQVSFKLSSVTAQDTAVYYCAR

SEQ ID NO: 1029 - protein, 32 aa, Artificial Sequence
  VH Framework 3 (FR3)
RLTISKDTSKNQVSLKMSSLTAADTAVYYCAR

SEQ ID NO: 1030 - protein, 32 aa, Artificial Sequence
  VH Framework 3 (FR3)
RLTISKDTSKNQVSLKMSSVQAADTAVYYCAR

SEQ ID NO: 1031 - protein, 32 aa, Artificial Sequence
  VH Framework 3 (FR3)
RLTISKDTSKNQVSLKMSSVTAQDTAVYYCAR

SEQ ID NO: 1032 - protein, 32 aa, Artificial Sequence
  VH Framework 3 (FR3)
RLTISKDTSKNQVSLKLSSLQAADTAVYYCAR

SEQ ID NO: 1033 - protein, 32 aa, Artificial Sequence
  VH Framework 3 (FR3)
RLTISKDTSKNQVSLKLSSLTAQDTAVYYCAR

SEQ ID NO: 1034 - protein, 32 aa, Artificial Sequence
  VH Framework 3 (FR3)
RLTISKDTSKNQVSLKLSSVQAQDTAVYYCAR

SEQ ID NO: 1035 - protein, 32 aa, Artificial Sequence
  VH Framework 3 (FR3)
RLTISKDTSKNQFSFKMSSLTAADTAVYYCAR

SEQ ID NO: 1036 - protein, 32 aa, Artificial Sequence
  VH Framework 3 (FR3)
RLTISKDTSKNQFSFKMSSVQAADTAVYYCAR

SEQ ID NO: 1037 - protein, 32 aa, Artificial Sequence
  VH Framework 3 (FR3)
RLTISKDTSKNQFSFKMSSVTAQDTAVYYCAR

SEQ ID NO: 1038 - protein, 32 aa, Artificial Sequence
  VH Framework 3 (FR3)
RLTISKDTSKNQFSFKLSSLQAADTAVYYCAR

SEQ ID NO: 1039 - protein, 32 aa, Artificial Sequence
  VH Framework 3 (FR3)
RLTISKDTSKNQFSFKLSSLTAQDTAVYYCAR

SEQ ID NO: 1040 - protein, 32 aa, Artificial Sequence
  VH Framework 3 (FR3)
RLTISKDTSKNQFSFKLSSVQAQDTAVYYCAR

SEQ ID NO: 1041 - protein, 32 aa, Artificial Sequence
  VH Framework 3 (FR3)
RLTISKDTSKNQFSLKMSSLQAADTAVYYCAR

SEQ ID NO: 1042 - protein, 32 aa, Artificial Sequence
  VH Framework 3 (FR3)
RLTISKDTSKNQFSLKMSSLTAQDTAVYYCAR

SEQ ID NO: 1043 - protein, 32 aa, Artificial Sequence
  VH Framework 3 (FR3)
RLTISKDTSKNQFSLKMSSVQAQDTAVYYCAR

SEQ ID NO: 1044 - protein, 32 aa, Artificial Sequence
  VH Framework 3 (FR3)
RLTISKDTSKNQFSLKLSSLQAQDTAVYYCAR

SEQ ID NO: 1045 - protein, 32 aa, Artificial Sequence
  VH Framework 3 (FR3)
RLTISVDNSKSQVSFKLSSVTAADTAVYYCAR

SEQ ID NO: 1046 - protein, 32 aa, Artificial Sequence
  VH Framework 3 (FR3)
RLTISVDNSKSQVSLKMSSVTAADTAVYYCAR

SEQ ID NO: 1047 - protein, 32 aa, Artificial Sequence
  VH Framework 3 (FR3)
RLTISVDNSKSQVSLKLSSLTAADTAVYYCAR

SEQ ID NO: 1048 - protein, 32 aa, Artificial Sequence
  VH Framework 3 (FR3)
RLTISVDNSKSQVSLKLSSVQAADTAVYYCAR

SEQ ID NO: 1049 - protein, 32 aa, Artificial Sequence
  VH Framework 3 (FR3)
RLTISVDNSKSQVSLKLSSVTAQDTAVYYCAR

SEQ ID NO: 1050 - protein, 32 aa, Artificial Sequence
  VH Framework 3 (FR3)
RLTISVDNSKSQFSFKMSSVTAADTAVYYCAR

SEQ ID NO: 1051 - protein, 32 aa, Artificial Sequence
  VH Framework 3 (FR3)
RLTISVDNSKSQFSFKLSSLTAADTAVYYCAR

SEQ ID NO: 1052 - protein, 32 aa, Artificial Sequence
  VH Framework 3 (FR3)
RLTISVDNSKSQFSFKLSSVQAADTAVYYCAR

SEQ ID NO: 1053 - protein, 32 aa, Artificial Sequence
  VH Framework 3 (FR3)
RLTISVDNSKSQFSFKLSSVTAQDTAVYYCAR

SEQ ID NO: 1054 - protein, 32 aa, Artificial Sequence
  VH Framework 3 (FR3)
RLTISVDNSKSQFSLKMSSLTAADTAVYYCAR

SEQ ID NO: 1055 - protein, 32 aa, Artificial Sequence
  VH Framework 3 (FR3)
RLTISVDNSKSQFSLKMSSVQAADTAVYYCAR

SEQ ID NO: 1056 - protein, 32 aa, Artificial Sequence
  VH Framework 3 (FR3)
RLTISVDNSKSQFSLKMSSVTAQDTAVYYCAR

SEQ ID NO: 1057 - protein, 32 aa, Artificial Sequence
  VH Framework 3 (FR3)
RLTISVDNSKSQFSLKLSSLQAADTAVYYCAR

SEQ ID NO: 1058 - protein, 32 aa, Artificial Sequence
  VH Framework 3 (FR3)
RLTISVDNSKSQFSLKLSSLTAQDTAVYYCAR

SEQ ID NO: 1059 - protein, 32 aa, Artificial Sequence
  VH Framework 3 (FR3)
RLTISVDNSKSQFSLKLSSVQAQDTAVYYCAR

SEQ ID NO: 1060 - protein, 32 aa, Artificial Sequence
  VH Framework 3 (FR3)
RLTISVDNSKNQVSFKMSSVTAADTAVYYCAR

SEQ ID NO: 1061 - protein, 32 aa, Artificial Sequence
  VH Framework 3 (FR3)
RLTISVDNSKNQVSFKLSSLTAADTAVYYCAR

SEQ ID NO: 1062 - protein, 32 aa, Artificial Sequence
  VH Framework 3 (FR3)
RLTISVDNSKNQVSFKLSSVQAADTAVYYCAR

SEQ ID NO: 1063 - protein, 32 aa, Artificial Sequence
  VH Framework 3 (FR3)
RLTISVDNSKNQVSFKLSSVTAQDTAVYYCAR

SEQ ID NO: 1064 - protein, 32 aa, Artificial Sequence
  VH Framework 3 (FR3)
RLTISVDNSKNQVSLKMSSLTAADTAVYYCAR

SEQ ID NO: 1065 - protein, 32 aa, Artificial Sequence
  VH Framework 3 (FR3)
RLTISVDNSKNQVSLKMSSVQAADTAVYYCAR

SEQ ID NO: 1066 - protein, 32 aa, Artificial Sequence
  VH Framework 3 (FR3)
RLTISVDNSKNQVSLKMSSVTAQDTAVYYCAR

SEQ ID NO: 1067 - protein, 32 aa, Artificial Sequence
  VH Framework 3 (FR3)
RLTISVDNSKNQVSLKLSSLQAADTAVYYCAR

SEQ ID NO: 1068 - protein, 32 aa, Artificial Sequence
  VH Framework 3 (FR3)
RLTISVDNSKNQVSLKLSSLTAQDTAVYYCAR

SEQ ID NO: 1069 - protein, 32 aa, Artificial Sequence
  VH Framework 3 (FR3)
RLTISVDNSKNQVSLKLSSVQAQDTAVYYCAR

SEQ ID NO: 1070 - protein, 32 aa, Artificial Sequence
  VH Framework 3 (FR3)
RLTISVDNSKNQFSFKMSSLTAADTAVYYCAR

SEQ ID NO: 1071 - protein, 32 aa, Artificial Sequence
  VH Framework 3 (FR3)
RLTISVDNSKNQFSFKMSSVQAADTAVYYCAR

SEQ ID NO: 1072 - protein, 32 aa, Artificial Sequence
  VH Framework 3 (FR3)
RLTISVDNSKNQFSFKMSSVTAQDTAVYYCAR

SEQ ID NO: 1073 - protein, 32 aa, Artificial Sequence
  VH Framework 3 (FR3)
RLTISVDNSKNQFSFKLSSLQAADTAVYYCAR

SEQ ID NO: 1074 - protein, 32 aa, Artificial Sequence
  VH Framework 3 (FR3)
RLTISVDNSKNQFSFKLSSLTAQDTAVYYCAR

SEQ ID NO: 1075 - protein, 32 aa, Artificial Sequence
  VH Framework 3 (FR3)
RLTISVDNSKNQFSFKLSSVQAQDTAVYYCAR

SEQ ID NO: 1076 - protein, 32 aa, Artificial Sequence
  VH Framework 3 (FR3)
RLTISVDNSKNQFSLKMSSLQAADTAVYYCAR

SEQ ID NO: 1077 - protein, 32 aa, Artificial Sequence
  VH Framework 3 (FR3)
RLTISVDNSKNQFSLKMSSLTAQDTAVYYCAR

SEQ ID NO: 1078 - protein, 32 aa, Artificial Sequence
  VH Framework 3 (FR3)
RLTISVDNSKNQFSLKMSSVQAQDTAVYYCAR

SEQ ID NO: 1079 - protein, 32 aa, Artificial Sequence
  VH Framework 3 (FR3)
RLTISVDNSKNQFSLKLSSLQAQDTAVYYCAR

SEQ ID NO: 1080 - protein, 32 aa, Artificial Sequence
  VH Framework 3 (FR3)
RLTISVDTSKSQVSFKMSSVTAADTAVYYCAR

SEQ ID NO: 1081 - protein, 32 aa, Artificial Sequence
  VH Framework 3 (FR3)
RLTISVDTSKSQVSFKLSSLTAADTAVYYCAR

SEQ ID NO: 1082 - protein, 32 aa, Artificial Sequence
  VH Framework 3 (FR3)
RLTISVDTSKSQVSFKLSSVQAADTAVYYCAR

SEQ ID NO: 1083 - protein, 32 aa, Artificial Sequence
  VH Framework 3 (FR3)
RLTISVDTSKSQVSFKLSSVTAQDTAVYYCAR

SEQ ID NO: 1084 - protein, 32 aa, Artificial Sequence
  VH Framework 3 (FR3)
RLTISVDTSKSQVSLKMSSLTAADTAVYYCAR

SEQ ID NO: 1085 - protein, 32 aa, Artificial Sequence
  VH Framework 3 (FR3)
RLTISVDTSKSQVSLKMSSVQAADTAVYYCAR

SEQ ID NO: 1086 - protein, 32 aa, Artificial Sequence
  VH Framework 3 (FR3)
RLTISVDTSKSQVSLKMSSVTAQDTAVYYCAR

SEQ ID NO: 1087 - protein, 32 aa, Artificial Sequence
  VH Framework 3 (FR3)
RLTISVDTSKSQVSLKLSSLQAADTAVYYCAR

SEQ ID NO: 1088 - protein, 32 aa, Artificial Sequence
  VH Framework 3 (FR3)
RLTISVDTSKSQVSLKLSSLTAQDTAVYYCAR

SEQ ID NO: 1089 - protein, 32 aa, Artificial Sequence
  VH Framework 3 (FR3)
RLTISVDTSKSQVSLKLSSVQAQDTAVYYCAR

SEQ ID NO: 1090 - protein, 32 aa, Artificial Sequence
  VH Framework 3 (FR3)
RLTISVDTSKSQFSFKMSSLTAADTAVYYCAR

SEQ ID NO: 1091 - protein, 32 aa, Artificial Sequence
  VH Framework 3 (FR3)
RLTISVDTSKSQFSFKMSSVQAADTAVYYCAR

SEQ ID NO: 1092 - protein, 32 aa, Artificial Sequence
  VH Framework 3 (FR3)
RLTISVDTSKSQFSFKMSSVTAQDTAVYYCAR

SEQ ID NO: 1093 - protein, 32 aa, Artificial Sequence
  VH Framework 3 (FR3)
RLTISVDTSKSQFSFKLSSLQAADTAVYYCAR

SEQ ID NO: 1094 - protein, 32 aa, Artificial Sequence
  VH Framework 3 (FR3)
RLTISVDTSKSQFSFKLSSLTAQDTAVYYCAR

SEQ ID NO: 1095 - protein, 32 aa, Artificial Sequence
  VH Framework 3 (FR3)
RLTISVDTSKSQFSFKLSSVQAQDTAVYYCAR

SEQ ID NO: 1096 - protein, 32 aa, Artificial Sequence
  VH Framework 3 (FR3)
RLTISVDTSKSQFSLKMSSLQAADTAVYYCAR

SEQ ID NO: 1097 - protein, 32 aa, Artificial Sequence
  VH Framework 3 (FR3)
RLTISVDTSKSQFSLKMSSLTAQDTAVYYCAR

SEQ ID NO: 1098 - protein, 32 aa, Artificial Sequence
  VH Framework 3 (FR3)
RLTISVDTSKSQFSLKMSSVQAQDTAVYYCAR

SEQ ID NO: 1099 - protein, 32 aa, Artificial Sequence
  VH Framework 3 (FR3)
RLTISVDTSKSQFSLKLSSLQAQDTAVYYCAR

SEQ ID NO: 1100 - protein, 32 aa, Artificial Sequence
  VH Framework 3 (FR3)
RLTISVDTSKNQVSFKMSSLTAADTAVYYCAR

SEQ ID NO: 1101 - protein, 32 aa, Artificial Sequence
  VH Framework 3 (FR3)
RLTISVDTSKNQVSFKMSSVQAADTAVYYCAR

SEQ ID NO: 1102 - protein, 32 aa, Artificial Sequence
  VH Framework 3 (FR3)
RLTISVDTSKNQVSFKMSSVTAQDTAVYYCAR

SEQ ID NO: 1103 - protein, 32 aa, Artificial Sequence
  VH Framework 3 (FR3)
RLTISVDTSKNQVSFKLSSLQAADTAVYYCAR

SEQ ID NO: 1104 - protein, 32 aa, Artificial Sequence
  VH Framework 3 (FR3)
RLTISVDTSKNQVSFKLSSLTAQDTAVYYCAR

SEQ ID NO: 1105 - protein, 32 aa, Artificial Sequence
  VH Framework 3 (FR3)
RLTISVDTSKNQVSFKLSSVQAQDTAVYYCAR

SEQ ID NO: 1106 - protein, 32 aa, Artificial Sequence
  VH Framework 3 (FR3)
RLTISVDTSKNQVSLKMSSLQAADTAVYYCAR

SEQ ID NO: 1107 - protein, 32 aa, Artificial Sequence
  VH Framework 3 (FR3)
RLTISVDTSKNQVSLKMSSLTAQDTAVYYCAR

SEQ ID NO: 1108 - protein, 32 aa, Artificial Sequence
  VH Framework 3 (FR3)
RLTISVDTSKNQVSLKMSSVQAQDTAVYYCAR

SEQ ID NO: 1109 - protein, 32 aa, Artificial Sequence
  VH Framework 3 (FR3)
RLTISVDTSKNQVSLKLSSLQAQDTAVYYCAR

SEQ ID NO: 1110 - protein, 32 aa, Artificial Sequence
  VH Framework 3 (FR3)
RLTISVDTSKNQFSFKMSSLQAADTAVYYCAR

SEQ ID NO: 1111 - protein, 32 aa, Artificial Sequence
  VH Framework 3 (FR3)
RLTISVDTSKNQFSFKMSSLTAQDTAVYYCAR

SEQ ID NO: 1112 - protein, 32 aa, Artificial Sequence
  VH Framework 3 (FR3)
RLTISVDTSKNQFSFKMSSVQAQDTAVYYCAR

SEQ ID NO: 1113 - protein, 32 aa, Artificial Sequence
  VH Framework 3 (FR3)
RLTISVDTSKNQFSFKLSSLQAQDTAVYYCAR

SEQ ID NO: 1114 - protein, 32 aa, Artificial Sequence
  VH Framework 3 (FR3)
RLTISVDTSKNQFSLKMSSLQAQDTAVYYCAR

SEQ ID NO: 1115 - protein, 32 aa, Artificial Sequence
  VH Framework 3 (FR3)
RVTISKDNSKSQVSFKLSSVTAADTAVYYCAR

SEQ ID NO: 1116 - protein, 32 aa, Artificial Sequence
  VH Framework 3 (FR3)
RVTISKDNSKSQVSLKMSSVTAADTAVYYCAR

SEQ ID NO: 1117 - protein, 32 aa, Artificial Sequence
  VH Framework 3 (FR3)
RVTISKDNSKSQVSLKLSSLTAADTAVYYCAR

SEQ ID NO: 1118 - protein, 32 aa, Artificial Sequence
  VH Framework 3 (FR3)
RVTISKDNSKSQVSLKLSSVQAADTAVYYCAR

SEQ ID NO: 1119 - protein, 32 aa, Artificial Sequence
  VH Framework 3 (FR3)
RVTISKDNSKSQVSLKLSSVTAQDTAVYYCAR

SEQ ID NO: 1120 - protein, 32 aa, Artificial Sequence
  VH Framework 3 (FR3)
RVTISKDNSKSQFSFKMSSVTAADTAVYYCAR

SEQ ID NO: 1121 - protein, 32 aa, Artificial Sequence
  VH Framework 3 (FR3)
RVTISKDNSKSQFSFKLSSLTAADTAVYYCAR

SEQ ID NO: 1122 - protein, 32 aa, Artificial Sequence
  VH Framework 3 (FR3)
RVTISKDNSKSQFSFKLSSVQAADTAVYYCAR

SEQ ID NO: 1123 - protein, 32 aa, Artificial Sequence
  VH Framework 3 (FR3)
RVTISKDNSKSQFSFKLSSVTAQDTAVYYCAR

SEQ ID NO: 1124 - protein, 32 aa, Artificial Sequence
  VH Framework 3 (FR3)
RVTISKDNSKSQFSLKMSSLTAADTAVYYCAR

SEQ ID NO: 1125 - protein, 32 aa, Artificial Sequence
  VH Framework 3 (FR3)
RVTISKDNSKSQFSLKMSSVQAADTAVYYCAR

SEQ ID NO: 1126 - protein, 32 aa, Artificial Sequence
  VH Framework 3 (FR3)
RVTISKDNSKSQFSLKMSSVTAQDTAVYYCAR

SEQ ID NO: 1127 - protein, 32 aa, Artificial Sequence
  VH Framework 3 (FR3)
RVTISKDNSKSQFSLKLSSLQAADTAVYYCAR

SEQ ID NO: 1128 - protein, 32 aa, Artificial Sequence
  VH Framework 3 (FR3)
RVTISKDNSKSQFSLKLSSLTAQDTAVYYCAR

SEQ ID NO: 1129 - protein, 32 aa, Artificial Sequence
  VH Framework 3 (FR3)
RVTISKDNSKSQFSLKLSSVQAQDTAVYYCAR

SEQ ID NO: 1130 - protein, 32 aa, Artificial Sequence
  VH Framework 3 (FR3)
RVTISKDNSKNQVSFKMSSVTAADTAVYYCAR

SEQ ID NO: 1131 - protein, 32 aa, Artificial Sequence
  VH Framework 3 (FR3)
RVTISKDNSKNQVSFKLSSLTAADTAVYYCAR

SEQ ID NO: 1132 - protein, 32 aa, Artificial Sequence
  VH Framework 3 (FR3)
RVTISKDNSKNQVSFKLSSVQAADTAVYYCAR

SEQ ID NO: 1133 - protein, 32 aa, Artificial Sequence
  VH Framework 3 (FR3)
RVTISKDNSKNQVSFKLSSVTAQDTAVYYCAR

SEQ ID NO: 1134 - protein, 32 aa, Artificial Sequence
  VH Framework 3 (FR3)
RVTISKDNSKNQVSLKMSSLTAADTAVYYCAR

SEQ ID NO: 1135 - protein, 32 aa, Artificial Sequence
  VH Framework 3 (FR3)
RVTISKDNSKNQVSLKMSSVQAADTAVYYCAR

SEQ ID NO: 1136 - protein, 32 aa, Artificial Sequence
  VH Framework 3 (FR3)
RVTISKDNSKNQVSLKMSSVTAQDTAVYYCAR

SEQ ID NO: 1137 - protein, 32 aa, Artificial Sequence
  VH Framework 3 (FR3)
RVTISKDNSKNQVSLKLSSLQAADTAVYYCAR

SEQ ID NO: 1138 - protein, 32 aa, Artificial Sequence
  VH Framework 3 (FR3)
RVTISKDNSKNQVSLKLSSLTAQDTAVYYCAR

SEQ ID NO: 1139 - protein, 32 aa, Artificial Sequence
  VH Framework 3 (FR3)
RVTISKDNSKNQVSLKLSSVQAQDTAVYYCAR

SEQ ID NO: 1140 - protein, 32 aa, Artificial Sequence
  VH Framework 3 (FR3)
RVTISKDNSKNQFSFKMSSLTAADTAVYYCAR

SEQ ID NO: 1141 - protein, 32 aa, Artificial Sequence
  VH Framework 3 (FR3)
RVTISKDNSKNQFSFKMSSVQAADTAVYYCAR

SEQ ID NO: 1142 - protein, 32 aa, Artificial Sequence
  VH Framework 3 (FR3)
RVTISKDNSKNQFSFKMSSVTAQDTAVYYCAR

SEQ ID NO: 1143 - protein, 32 aa, Artificial Sequence
  VH Framework 3 (FR3)
RVTISKDNSKNQFSFKLSSLQAADTAVYYCAR

SEQ ID NO: 1144 - protein, 32 aa, Artificial Sequence
  VH Framework 3 (FR3)
RVTISKDNSKNQFSFKLSSLTAQDTAVYYCAR

SEQ ID NO: 1145 - protein, 32 aa, Artificial Sequence
  VH Framework 3 (FR3)
RVTISKDNSKNQFSFKLSSVQAQDTAVYYCAR

SEQ ID NO: 1146 - protein, 32 aa, Artificial Sequence
  VH Framework 3 (FR3)
RVTISKDNSKNQFSLKMSSLQAADTAVYYCAR

SEQ ID NO: 1147 - protein, 32 aa, Artificial Sequence
  VH Framework 3 (FR3)
RVTISKDNSKNQFSLKMSSLTAQDTAVYYCAR

SEQ ID NO: 1148 - protein, 32 aa, Artificial Sequence
  VH Framework 3 (FR3)
RVTISKDNSKNQFSLKMSSVQAQDTAVYYCAR

SEQ ID NO: 1149 - protein, 32 aa, Artificial Sequence
  VH Framework 3 (FR3)
RVTISKDNSKNQFSLKLSSLQAQDTAVYYCAR

SEQ ID NO: 1150 - protein, 32 aa, Artificial Sequence
  VH Framework 3 (FR3)
RVTISKDTSKSQVSFKMSSVTAADTAVYYCAR

SEQ ID NO: 1151 - protein, 32 aa, Artificial Sequence
  VH Framework 3 (FR3)
RVTISKDTSKSQVSFKLSSLTAADTAVYYCAR

SEQ ID NO: 1152 - protein, 32 aa, Artificial Sequence
  VH Framework 3 (FR3)
RVTISKDTSKSQVSFKLSSVQAADTAVYYCAR

SEQ ID NO: 1153 - protein, 32 aa, Artificial Sequence
  VH Framework 3 (FR3)
RVTISKDTSKSQVSFKLSSVTAQDTAVYYCAR

SEQ ID NO: 1154 - protein, 32 aa, Artificial Sequence
  VH Framework 3 (FR3)
RVTISKDTSKSQVSLKMSSLTAADTAVYYCAR

SEQ ID NO: 1155 - protein, 32 aa, Artificial Sequence
  VH Framework 3 (FR3)
RVTISKDTSKSQVSLKMSSVQAADTAVYYCAR

SEQ ID NO: 1156 - protein, 32 aa, Artificial Sequence
  VH Framework 3 (FR3)
RVTISKDTSKSQVSLKMSSVTAQDTAVYYCAR

SEQ ID NO: 1157 - protein, 32 aa, Artificial Sequence
  VH Framework 3 (FR3)
RVTISKDTSKSQVSLKLSSLQAADTAVYYCAR

SEQ ID NO: 1158 - protein, 32 aa, Artificial Sequence
  VH Framework 3 (FR3)
RVTISKDTSKSQVSLKLSSLTAQDTAVYYCAR

SEQ ID NO: 1159 - protein, 32 aa, Artificial Sequence
  VH Framework 3 (FR3)
RVTISKDTSKSQVSLKLSSVQAQDTAVYYCAR

SEQ ID NO: 1160 - protein, 32 aa, Artificial Sequence
  VH Framework 3 (FR3)
RVTISKDTSKSQFSFKMSSLTAADTAVYYCAR

SEQ ID NO: 1161 - protein, 32 aa, Artificial Sequence
  VH Framework 3 (FR3)
RVTISKDTSKSQFSFKMSSVQAADTAVYYCAR

SEQ ID NO: 1162 - protein, 32 aa, Artificial Sequence
  VH Framework 3 (FR3)
RVTISKDTSKSQFSFKMSSVTAQDTAVYYCAR

SEQ ID NO: 1163 - protein, 32 aa, Artificial Sequence
  VH Framework 3 (FR3)
RVTISKDTSKSQFSFKLSSLQAADTAVYYCAR

SEQ ID NO: 1164 - protein, 32 aa, Artificial Sequence
  VH Framework 3 (FR3)
RVTISKDTSKSQFSFKLSSLTAQDTAVYYCAR

SEQ ID NO: 1165 - protein, 32 aa, Artificial Sequence
  VH Framework 3 (FR3)
RVTISKDTSKSQFSFKLSSVQAQDTAVYYCAR

SEQ ID NO: 1166 - protein, 32 aa, Artificial Sequence
  VH Framework 3 (FR3)
RVTISKDTSKSQFSLKMSSLQAADTAVYYCAR

SEQ ID NO: 1167 - protein, 32 aa, Artificial Sequence
  VH Framework 3 (FR3)
RVTISKDTSKSQFSLKMSSLTAQDTAVYYCAR

SEQ ID NO: 1168 - protein, 32 aa, Artificial Sequence
  VH Framework 3 (FR3)
RVTISKDTSKSQFSLKMSSVQAQDTAVYYCAR

SEQ ID NO: 1169 - protein, 32 aa, Artificial Sequence
  VH Framework 3 (FR3)
RVTISKDTSKSQFSLKLSSLQAQDTAVYYCAR

SEQ ID NO: 1170 - protein, 32 aa, Artificial Sequence
  VH Framework 3 (FR3)
RVTISKDTSKNQVSFKMSSLTAADTAVYYCAR

SEQ ID NO: 1171 - protein, 32 aa, Artificial Sequence
  VH Framework 3 (FR3)
RVTISKDTSKNQVSFKMSSVQAADTAVYYCAR

SEQ ID NO: 1172 - protein, 32 aa, Artificial Sequence
  VH Framework 3 (FR3)
RVTISKDTSKNQVSFKMSSVTAQDTAVYYCAR

SEQ ID NO: 1173 - protein, 32 aa, Artificial Sequence
  VH Framework 3 (FR3)
RVTISKDTSKNQVSFKLSSLQAADTAVYYCAR

SEQ ID NO: 1174 - protein, 32 aa, Artificial Sequence
  VH Framework 3 (FR3)
RVTISKDTSKNQVSFKLSSLTAQDTAVYYCAR

SEQ ID NO: 1175 - protein, 32 aa, Artificial Sequence
  VH Framework 3 (FR3)
RVTISKDTSKNQVSFKLSSVQAQDTAVYYCAR

SEQ ID NO: 1176 - protein, 32 aa, Artificial Sequence
  VH Framework 3 (FR3)
RVTISKDTSKNQVSLKMSSLQAADTAVYYCAR

SEQ ID NO: 1177 - protein, 32 aa, Artificial Sequence
  VH Framework 3 (FR3)
RVTISKDTSKNQVSLKMSSLTAQDTAVYYCAR

SEQ ID NO: 1178 - protein, 32 aa, Artificial Sequence
  VH Framework 3 (FR3)
RVTISKDTSKNQVSLKMSSVQAQDTAVYYCAR

SEQ ID NO: 1179 - protein, 32 aa, Artificial Sequence
  VH Framework 3 (FR3)
RVTISKDTSKNQVSLKLSSLQAQDTAVYYCAR

SEQ ID NO: 1180 - protein, 32 aa, Artificial Sequence
  VH Framework 3 (FR3)
RVTISKDTSKNQFSFKMSSLQAADTAVYYCAR

SEQ ID NO: 1181 - protein, 32 aa, Artificial Sequence
  VH Framework 3 (FR3)
RVTISKDTSKNQFSFKMSSLTAQDTAVYYCAR

SEQ ID NO: 1182 - protein, 32 aa, Artificial Sequence
  VH Framework 3 (FR3)
RVTISKDTSKNQFSFKMSSVQAQDTAVYYCAR

SEQ ID NO: 1183 - protein, 32 aa, Artificial Sequence
  VH Framework 3 (FR3)
RVTISKDTSKNQFSFKLSSLQAQDTAVYYCAR

SEQ ID NO: 1184 - protein, 32 aa, Artificial Sequence
  VH Framework 3 (FR3)
RVTISKDTSKNQFSLKMSSLQAQDTAVYYCAR

SEQ ID NO: 1185 - protein, 32 aa, Artificial Sequence
  VH Framework 3 (FR3)
RVTISVDNSKSQVSFKMSSVTAADTAVYYCAR

SEQ ID NO: 1186 - protein, 32 aa, Artificial Sequence
  VH Framework 3 (FR3)
RVTISVDNSKSQVSFKLSSLTAADTAVYYCAR

SEQ ID NO: 1187 - protein, 32 aa, Artificial Sequence
  VH Framework 3 (FR3)
RVTISVDNSKSQVSFKLSSVQAADTAVYYCAR

SEQ ID NO: 1188 - protein, 32 aa, Artificial Sequence
  VH Framework 3 (FR3)
RVTISVDNSKSQVSFKLSSVTAQDTAVYYCAR

SEQ ID NO: 1189 - protein, 32 aa, Artificial Sequence
  VH Framework 3 (FR3)
RVTISVDNSKSQVSLKMSSLTAADTAVYYCAR

SEQ ID NO: 1190 - protein, 32 aa, Artificial Sequence
  VH Framework 3 (FR3)
RVTISVDNSKSQVSLKMSSVQAADTAVYYCAR

SEQ ID NO: 1191 - protein, 32 aa, Artificial Sequence
  VH Framework 3 (FR3)
RVTISVDNSKSQVSLKMSSVTAQDTAVYYCAR

SEQ ID NO: 1192 - protein, 32 aa, Artificial Sequence
  VH Framework 3 (FR3)
RVTISVDNSKSQVSLKLSSLQAADTAVYYCAR

SEQ ID NO: 1193 - protein, 32 aa, Artificial Sequence
  VH Framework 3 (FR3)
RVTISVDNSKSQVSLKLSSLTAQDTAVYYCAR

SEQ ID NO: 1194 - protein, 32 aa, Artificial Sequence
  VH Framework 3 (FR3)
RVTISVDNSKSQVSLKLSSVQAQDTAVYYCAR

SEQ ID NO: 1195 - protein, 32 aa, Artificial Sequence
  VH Framework 3 (FR3)
RVTISVDNSKSQFSFKMSSLTAADTAVYYCAR

SEQ ID NO: 1196 - protein, 32 aa, Artificial Sequence
  VH Framework 3 (FR3)
RVTISVDNSKSQFSFKMSSVQAADTAVYYCAR

SEQ ID NO: 1197 - protein, 32 aa, Artificial Sequence
  VH Framework 3 (FR3)
RVTISVDNSKSQFSFKMSSVTAQDTAVYYCAR

SEQ ID NO: 1198 - protein, 32 aa, Artificial Sequence
  VH Framework 3 (FR3)
RVTISVDNSKSQFSFKLSSLQAADTAVYYCAR

SEQ ID NO: 1199 - protein, 32 aa, Artificial Sequence
  VH Framework 3 (FR3)
RVTISVDNSKSQFSFKLSSLTAQDTAVYYCAR

SEQ ID NO: 1200 - protein, 32 aa, Artificial Sequence
  VH Framework 3 (FR3)
RVTISVDNSKSQFSFKLSSVQAQDTAVYYCAR

SEQ ID NO: 1201 - protein, 32 aa, Artificial Sequence
  VH Framework 3 (FR3)
RVTISVDNSKSQFSLKMSSLQAADTAVYYCAR

SEQ ID NO: 1202 - protein, 32 aa, Artificial Sequence
  VH Framework 3 (FR3)
RVTISVDNSKSQFSLKMSSLTAQDTAVYYCAR

SEQ ID NO: 1203 - protein, 32 aa, Artificial Sequence
  VH Framework 3 (FR3)
RVTISVDNSKSQFSLKMSSVQAQDTAVYYCAR

SEQ ID NO: 1204 - protein, 32 aa, Artificial Sequence
  VH Framework 3 (FR3)
RVTISVDNSKSQFSLKLSSLQAQDTAVYYCAR

SEQ ID NO: 1205 - protein, 32 aa, Artificial Sequence
  VH Framework 3 (FR3)
RVTISVDNSKNQVSFKMSSLTAADTAVYYCAR

SEQ ID NO: 1206 - protein, 32 aa, Artificial Sequence
  VH Framework 3 (FR3)
RVTISVDNSKNQVSFKMSSVQAADTAVYYCAR

SEQ ID NO: 1207 - protein, 32 aa, Artificial Sequence
  VH Framework 3 (FR3)
RVTISVDNSKNQVSFKMSSVTAQDTAVYYCAR

SEQ ID NO: 1208 - protein, 32 aa, Artificial Sequence
  VH Framework 3 (FR3)
RVTISVDNSKNQVSFKLSSLQAADTAVYYCAR

SEQ ID NO: 1209 - protein, 32 aa, Artificial Sequence
  VH Framework 3 (FR3)
RVTISVDNSKNQVSFKLSSLTAQDTAVYYCAR

SEQ ID NO: 1210 - protein, 32 aa, Artificial Sequence
  VH Framework 3 (FR3)
RVTISVDNSKNQVSFKLSSVQAQDTAVYYCAR

SEQ ID NO: 1211 - protein, 32 aa, Artificial Sequence
  VH Framework 3 (FR3)
RVTISVDNSKNQVSLKMSSLQAADTAVYYCAR

SEQ ID NO: 1212 - protein, 32 aa, Artificial Sequence
  VH Framework 3 (FR3)
RVTISVDNSKNQVSLKMSSLTAQDTAVYYCAR

SEQ ID NO: 1213 - protein, 32 aa, Artificial Sequence
  VH Framework 3 (FR3)
RVTISVDNSKNQVSLKMSSVQAQDTAVYYCAR

SEQ ID NO: 1214 - protein, 32 aa, Artificial Sequence
  VH Framework 3 (FR3)
RVTISVDNSKNQVSLKLSSLQAQDTAVYYCAR

SEQ ID NO: 1215 - protein, 32 aa, Artificial Sequence
  VH Framework 3 (FR3)
RVTISVDNSKNQFSFKMSSLQAADTAVYYCAR

SEQ ID NO: 1216 - protein, 32 aa, Artificial Sequence
  VH Framework 3 (FR3)
RVTISVDNSKNQFSFKMSSLTAQDTAVYYCAR

SEQ ID NO: 1217 - protein, 32 aa, Artificial Sequence
  VH Framework 3 (FR3)
RVTISVDNSKNQFSFKMSSVQAQDTAVYYCAR

SEQ ID NO: 1218 - protein, 32 aa, Artificial Sequence
  VH Framework 3 (FR3)
RVTISVDNSKNQFSFKLSSLQAQDTAVYYCAR

SEQ ID NO: 1219 - protein, 32 aa, Artificial Sequence
  VH Framework 3 (FR3)
RVTISVDNSKNQFSLKMSSLQAQDTAVYYCAR

SEQ ID NO: 1220 - protein, 32 aa, Artificial Sequence
  VH Framework 3 (FR3)
RVTISVDTSKSQVSFKMSSLTAADTAVYYCAR

SEQ ID NO: 1221 - protein, 32 aa, Artificial Sequence
  VH Framework 3 (FR3)
RVTISVDTSKSQVSFKMSSVQAADTAVYYCAR

SEQ ID NO: 1222 - protein, 32 aa, Artificial Sequence
  VH Framework 3 (FR3)
RVTISVDTSKSQVSFKMSSVTAQDTAVYYCAR

SEQ ID NO: 1223 - protein, 32 aa, Artificial Sequence
  VH Framework 3 (FR3)
RVTISVDTSKSQVSFKLSSLQAADTAVYYCAR

SEQ ID NO: 1224 - protein, 32 aa, Artificial Sequence
  VH Framework 3 (FR3)
RVTISVDTSKSQVSFKLSSLTAQDTAVYYCAR

SEQ ID NO: 1225 - protein, 32 aa, Artificial Sequence
  VH Framework 3 (FR3)
RVTISVDTSKSQVSFKLSSVQAQDTAVYYCAR

SEQ ID NO: 1226 - protein, 32 aa, Artificial Sequence
  VH Framework 3 (FR3)
RVTISVDTSKSQVSLKMSSLQAADTAVYYCAR

SEQ ID NO: 1227 - protein, 32 aa, Artificial Sequence
  VH Framework 3 (FR3)
RVTISVDTSKSQVSLKMSSLTAQDTAVYYCAR

SEQ ID NO: 1228 - protein, 32 aa, Artificial Sequence
  VH Framework 3 (FR3)
RVTISVDTSKSQVSLKMSSVQAQDTAVYYCAR

SEQ ID NO: 1229 - protein, 32 aa, Artificial Sequence
  VH Framework 3 (FR3)
RVTISVDTSKSQVSLKLSSLQAQDTAVYYCAR

SEQ ID NO: 1230 - protein, 32 aa, Artificial Sequence
  VH Framework 3 (FR3)
RVTISVDTSKSQFSFKMSSLQAADTAVYYCAR

SEQ ID NO: 1231 - protein, 32 aa, Artificial Sequence
  VH Framework 3 (FR3)
RVTISVDTSKSQFSFKMSSLTAQDTAVYYCAR

SEQ ID NO: 1232 - protein, 32 aa, Artificial Sequence
  VH Framework 3 (FR3)
RVTISVDTSKSQFSFKMSSVQAQDTAVYYCAR

SEQ ID NO: 1233 - protein, 32 aa, Artificial Sequence
  VH Framework 3 (FR3)
RVTISVDTSKSQFSFKLSSLQAQDTAVYYCAR

SEQ ID NO: 1234 - protein, 32 aa, Artificial Sequence
  VH Framework 3 (FR3)
RVTISVDTSKSQFSLKMSSLQAQDTAVYYCAR

SEQ ID NO: 1235 - protein, 32 aa, Artificial Sequence
  VH Framework 3 (FR3)
RVTISVDTSKNQVSFKMSSLQAADTAVYYCAR

SEQ ID NO: 1236 - protein, 32 aa, Artificial Sequence
  VH Framework 3 (FR3)
RVTISVDTSKNQVSFKMSSLTAQDTAVYYCAR

SEQ ID NO: 1237 - protein, 32 aa, Artificial Sequence
  VH Framework 3 (FR3)
RVTISVDTSKNQVSFKMSSVQAQDTAVYYCAR

SEQ ID NO: 1238 - protein, 32 aa, Artificial Sequence
  VH Framework 3 (FR3)
RVTISVDTSKNQVSFKLSSLQAQDTAVYYCAR

SEQ ID NO: 1239 - protein, 32 aa, Artificial Sequence
  VH Framework 3 (FR3)
RVTISVDTSKNQVSLKMSSLQAQDTAVYYCAR

SEQ ID NO: 1240 - protein, 32 aa, Artificial Sequence
  VH Framework 3 (FR3)
RVTISVDTSKNQFSFKMSSLQAQDTAVYYCAR

SEQ ID NO: 1241 - protein, 32 aa, Artificial Sequence
  VH Framework 3 (FR3)
RLTISKDNSKSQVSFKLSSVTAADTAVYYCAR

SEQ ID NO: 1242 - protein, 32 aa, Artificial Sequence
  VH Framework 3 (FR3)
RLTISKDNSKSQVSLKMSSVTAADTAVYYCAR

SEQ ID NO: 1243 - protein, 32 aa, Artificial Sequence
  VH Framework 3 (FR3)
RLTISKDNSKSQVSLKLSSLTAADTAVYYCAR

SEQ ID NO: 1244 - protein, 32 aa, Artificial Sequence
  VH Framework 3 (FR3)
RLTISKDNSKSQVSLKLSSVQAADTAVYYCAR

SEQ ID NO: 1245 - protein, 32 aa, Artificial Sequence
  VH Framework 3 (FR3)
RLTISKDNSKSQVSLKLSSVTAQDTAVYYCAR

SEQ ID NO: 1246 - protein, 32 aa, Artificial Sequence
  VH Framework 3 (FR3)
RLTISKDNSKSQFSFKMSSVTAADTAVYYCAR

SEQ ID NO: 1247 - protein, 32 aa, Artificial Sequence
  VH Framework 3 (FR3)
RLTISKDNSKSQFSFKLSSLTAADTAVYYCAR

SEQ ID NO: 1248 - protein, 32 aa, Artificial Sequence
  VH Framework 3 (FR3)
RLTISKDNSKSQFSFKLSSVQAADTAVYYCAR

SEQ ID NO: 1249 - protein, 32 aa, Artificial Sequence
  VH Framework 3 (FR3)
RLTISKDNSKSQFSFKLSSVTAQDTAVYYCAR

SEQ ID NO: 1250 - protein, 32 aa, Artificial Sequence
  VH Framework 3 (FR3)
RLTISKDNSKSQFSLKMSSLTAADTAVYYCAR

SEQ ID NO: 1251 - protein, 32 aa, Artificial Sequence
  VH Framework 3 (FR3)
RLTISKDNSKSQFSLKMSSVQAADTAVYYCAR

SEQ ID NO: 1252 - protein, 32 aa, Artificial Sequence
  VH Framework 3 (FR3)
RLTISKDNSKSQFSLKMSSVTAQDTAVYYCAR

SEQ ID NO: 1253 - protein, 32 aa, Artificial Sequence
  VH Framework 3 (FR3)
RLTISKDNSKSQFSLKLSSLQAADTAVYYCAR

SEQ ID NO: 1254 - protein, 32 aa, Artificial Sequence
  VH Framework 3 (FR3)
RLTISKDNSKSQFSLKLSSLTAQDTAVYYCAR

SEQ ID NO: 1255 - protein, 32 aa, Artificial Sequence
  VH Framework 3 (FR3)
RLTISKDNSKSQFSLKLSSVQAQDTAVYYCAR

SEQ ID NO: 1256 - protein, 32 aa, Artificial Sequence
  VH Framework 3 (FR3)
RLTISKDNSKNQVSFKMSSVTAADTAVYYCAR

SEQ ID NO: 1257 - protein, 32 aa, Artificial Sequence
  VH Framework 3 (FR3)
RLTISKDNSKNQVSFKLSSLTAADTAVYYCAR

SEQ ID NO: 1258 - protein, 32 aa, Artificial Sequence
  VH Framework 3 (FR3)
RLTISKDNSKNQVSFKLSSVQAADTAVYYCAR

SEQ ID NO: 1259 - protein, 32 aa, Artificial Sequence
  VH Framework 3 (FR3)
RLTISKDNSKNQVSFKLSSVTAQDTAVYYCAR

SEQ ID NO: 1260 - protein, 32 aa, Artificial Sequence
  VH Framework 3 (FR3)
RLTISKDNSKNQVSLKMSSLTAADTAVYYCAR

SEQ ID NO: 1261 - protein, 32 aa, Artificial Sequence
  VH Framework 3 (FR3)
RLTISKDNSKNQVSLKMSSVQAADTAVYYCAR

SEQ ID NO: 1262 - protein, 32 aa, Artificial Sequence
  VH Framework 3 (FR3)
RLTISKDNSKNQVSLKMSSVTAQDTAVYYCAR

SEQ ID NO: 1263 - protein, 32 aa, Artificial Sequence
  VH Framework 3 (FR3)
RLTISKDNSKNQVSLKLSSLQAADTAVYYCAR

SEQ ID NO: 1264 - protein, 32 aa, Artificial Sequence
  VH Framework 3 (FR3)
RLTISKDNSKNQVSLKLSSLTAQDTAVYYCAR

SEQ ID NO: 1265 - protein, 32 aa, Artificial Sequence
  VH Framework 3 (FR3)
RLTISKDNSKNQVSLKLSSVQAQDTAVYYCAR

SEQ ID NO: 1266 - protein, 32 aa, Artificial Sequence
  VH Framework 3 (FR3)
RLTISKDNSKNQFSFKMSSLTAADTAVYYCAR

SEQ ID NO: 1267 - protein, 32 aa, Artificial Sequence
  VH Framework 3 (FR3)
RLTISKDNSKNQFSFKMSSVQAADTAVYYCAR

SEQ ID NO: 1268 - protein, 32 aa, Artificial Sequence
  VH Framework 3 (FR3)
RLTISKDNSKNQFSFKMSSVTAQDTAVYYCAR

SEQ ID NO: 1269 - protein, 32 aa, Artificial Sequence
  VH Framework 3 (FR3)
RLTISKDNSKNQFSFKLSSLQAADTAVYYCAR

SEQ ID NO: 1270 - protein, 32 aa, Artificial Sequence
  VH Framework 3 (FR3)
RLTISKDNSKNQFSFKLSSLTAQDTAVYYCAR

SEQ ID NO: 1271 - protein, 32 aa, Artificial Sequence
  VH Framework 3 (FR3)
RLTISKDNSKNQFSFKLSSVQAQDTAVYYCAR

SEQ ID NO: 1272 - protein, 32 aa, Artificial Sequence
  VH Framework 3 (FR3)
RLTISKDNSKNQFSLKMSSLQAADTAVYYCAR

SEQ ID NO: 1273 - protein, 32 aa, Artificial Sequence
  VH Framework 3 (FR3)
RLTISKDNSKNQFSLKMSSLTAQDTAVYYCAR

SEQ ID NO: 1274 - protein, 32 aa, Artificial Sequence
  VH Framework 3 (FR3)
RLTISKDNSKNQFSLKMSSVQAQDTAVYYCAR

SEQ ID NO: 1275 - protein, 32 aa, Artificial Sequence
  VH Framework 3 (FR3)
RLTISKDNSKNQFSLKLSSLQAQDTAVYYCAR

SEQ ID NO: 1276 - protein, 32 aa, Artificial Sequence
  VH Framework 3 (FR3)
RLTISKDTSKSQVSFKMSSVTAADTAVYYCAR

SEQ ID NO: 1277 - protein, 32 aa, Artificial Sequence
  VH Framework 3 (FR3)
RLTISKDTSKSQVSFKLSSLTAADTAVYYCAR

SEQ ID NO: 1278 - protein, 32 aa, Artificial Sequence
  VH Framework 3 (FR3)
RLTISKDTSKSQVSFKLSSVQAADTAVYYCAR

SEQ ID NO: 1279 - protein, 32 aa, Artificial Sequence
  VH Framework 3 (FR3)
RLTISKDTSKSQVSFKLSSVTAQDTAVYYCAR

SEQ ID NO: 1280 - protein, 32 aa, Artificial Sequence
  VH Framework 3 (FR3)
RLTISKDTSKSQVSLKMSSLTAADTAVYYCAR

SEQ ID NO: 1281 - protein, 32 aa, Artificial Sequence
  VH Framework 3 (FR3)
RLTISKDTSKSQVSLKMSSVQAADTAVYYCAR

SEQ ID NO: 1282 - protein, 32 aa, Artificial Sequence
  VH Framework 3 (FR3)
RLTISKDTSKSQVSLKMSSVTAQDTAVYYCAR

SEQ ID NO: 1283 - protein, 32 aa, Artificial Sequence
  VH Framework 3 (FR3)
RLTISKDTSKSQVSLKLSSLQAADTAVYYCAR

SEQ ID NO: 1284 - protein, 32 aa, Artificial Sequence
  VH Framework 3 (FR3)
RLTISKDTSKSQVSLKLSSLTAQDTAVYYCAR

SEQ ID NO: 1285 - protein, 32 aa, Artificial Sequence
  VH Framework 3 (FR3)
RLTISKDTSKSQVSLKLSSVQAQDTAVYYCAR

SEQ ID NO: 1286 - protein, 32 aa, Artificial Sequence
  VH Framework 3 (FR3)
RLTISKDTSKSQFSFKMSSLTAADTAVYYCAR

SEQ ID NO: 1287 - protein, 32 aa, Artificial Sequence
  VH Framework 3 (FR3)
RLTISKDTSKSQFSFKMSSVQAADTAVYYCAR

SEQ ID NO: 1288 - protein, 32 aa, Artificial Sequence
  VH Framework 3 (FR3)
RLTISKDTSKSQFSFKMSSVTAQDTAVYYCAR

SEQ ID NO: 1289 - protein, 32 aa, Artificial Sequence
  VH Framework 3 (FR3)
RLTISKDTSKSQFSFKLSSLQAADTAVYYCAR

SEQ ID NO: 1290 - protein, 32 aa, Artificial Sequence
  VH Framework 3 (FR3)
RLTISKDTSKSQFSFKLSSLTAQDTAVYYCAR

SEQ ID NO: 1291 - protein, 32 aa, Artificial Sequence
  VH Framework 3 (FR3)
RLTISKDTSKSQFSFKLSSVQAQDTAVYYCAR

SEQ ID NO: 1292 - protein, 32 aa, Artificial Sequence
  VH Framework 3 (FR3)
RLTISKDTSKSQFSLKMSSLQAADTAVYYCAR

SEQ ID NO: 1293 - protein, 32 aa, Artificial Sequence
  VH Framework 3 (FR3)
RLTISKDTSKSQFSLKMSSLTAQDTAVYYCAR

SEQ ID NO: 1294 - protein, 32 aa, Artificial Sequence
  VH Framework 3 (FR3)
RLTISKDTSKSQFSLKMSSVQAQDTAVYYCAR

SEQ ID NO: 1295 - protein, 32 aa, Artificial Sequence
  VH Framework 3 (FR3)
RLTISKDTSKSQFSLKLSSLQAQDTAVYYCAR

SEQ ID NO: 1296 - protein, 32 aa, Artificial Sequence
  VH Framework 3 (FR3)
RLTISKDTSKNQVSFKMSSLTAADTAVYYCAR

SEQ ID NO: 1297 - protein, 32 aa, Artificial Sequence
  VH Framework 3 (FR3)
RLTISKDTSKNQVSFKMSSVQAADTAVYYCAR

SEQ ID NO: 1298 - protein, 32 aa, Artificial Sequence
  VH Framework 3 (FR3)
RLTISKDTSKNQVSFKMSSVTAQDTAVYYCAR

SEQ ID NO: 1299 - protein, 32 aa, Artificial Sequence
  VH Framework 3 (FR3)
RLTISKDTSKNQVSFKLSSLQAADTAVYYCAR

SEQ ID NO: 1300 - protein, 32 aa, Artificial Sequence
  VH Framework 3 (FR3)
RLTISKDTSKNQVSFKLSSLTAQDTAVYYCAR

SEQ ID NO: 1301 - protein, 32 aa, Artificial Sequence
  VH Framework 3 (FR3)
RLTISKDTSKNQVSFKLSSVQAQDTAVYYCAR

SEQ ID NO: 1302 - protein, 32 aa, Artificial Sequence
  VH Framework 3 (FR3)
RLTISKDTSKNQVSLKMSSLQAADTAVYYCAR

SEQ ID NO: 1303 - protein, 32 aa, Artificial Sequence
  VH Framework 3 (FR3)
RLTISKDTSKNQVSLKMSSLTAQDTAVYYCAR

SEQ ID NO: 1304 - protein, 32 aa, Artificial Sequence
  VH Framework 3 (FR3)
RLTISKDTSKNQVSLKMSSVQAQDTAVYYCAR

SEQ ID NO: 1305 - protein, 32 aa, Artificial Sequence
  VH Framework 3 (FR3)
RLTISKDTSKNQVSLKLSSLQAQDTAVYYCAR

SEQ ID NO: 1306 - protein, 32 aa, Artificial Sequence
  VH Framework 3 (FR3)
RLTISKDTSKNQFSFKMSSLQAADTAVYYCAR

SEQ ID NO: 1307 - protein, 32 aa, Artificial Sequence
  VH Framework 3 (FR3)
RLTISKDTSKNQFSFKMSSLTAQDTAVYYCAR

SEQ ID NO: 1308 - protein, 32 aa, Artificial Sequence
  VH Framework 3 (FR3)
RLTISKDTSKNQFSFKMSSVQAQDTAVYYCAR

SEQ ID NO: 1309 - protein, 32 aa, Artificial Sequence
  VH Framework 3 (FR3)
RLTISKDTSKNQFSFKLSSLQAQDTAVYYCAR

SEQ ID NO: 1310 - protein, 32 aa, Artificial Sequence
  VH Framework 3 (FR3)
RLTISKDTSKNQFSLKMSSLQAQDTAVYYCAR

SEQ ID NO: 1311 - protein, 32 aa, Artificial Sequence
  VH Framework 3 (FR3)
RLTISVDNSKSQVSFKMSSVTAADTAVYYCAR

SEQ ID NO: 1312 - protein, 32 aa, Artificial Sequence
  VH Framework 3 (FR3)
RLTISVDNSKSQVSFKLSSLTAADTAVYYCAR

SEQ ID NO: 1313 - protein, 32 aa, Artificial Sequence
  VH Framework 3 (FR3)
RLTISVDNSKSQVSFKLSSVQAADTAVYYCAR

SEQ ID NO: 1314 - protein, 32 aa, Artificial Sequence
  VH Framework 3 (FR3)
RLTISVDNSKSQVSFKLSSVTAQDTAVYYCAR

SEQ ID NO: 1315 - protein, 32 aa, Artificial Sequence
  VH Framework 3 (FR3)
RLTISVDNSKSQVSLKMSSLTAADTAVYYCAR

SEQ ID NO: 1316 - protein, 32 aa, Artificial Sequence
  VH Framework 3 (FR3)
RLTISVDNSKSQVSLKMSSVQAADTAVYYCAR

SEQ ID NO: 1317 - protein, 32 aa, Artificial Sequence
  VH Framework 3 (FR3)
RLTISVDNSKSQVSLKMSSVTAQDTAVYYCAR

SEQ ID NO: 1318 - protein, 32 aa, Artificial Sequence
  VH Framework 3 (FR3)
RLTISVDNSKSQVSLKLSSLQAADTAVYYCAR

SEQ ID NO: 1319 - protein, 32 aa, Artificial Sequence
  VH Framework 3 (FR3)
RLTISVDNSKSQVSLKLSSLTAQDTAVYYCAR

SEQ ID NO: 1320 - protein, 32 aa, Artificial Sequence
  VH Framework 3 (FR3)
RLTISVDNSKSQVSLKLSSVQAQDTAVYYCAR

SEQ ID NO: 1321 - protein, 32 aa, Artificial Sequence
  VH Framework 3 (FR3)
RLTISVDNSKSQFSFKMSSLTAADTAVYYCAR

SEQ ID NO: 1322 - protein, 32 aa, Artificial Sequence
  VH Framework 3 (FR3)
RLTISVDNSKSQFSFKMSSVQAADTAVYYCAR

SEQ ID NO: 1323 - protein, 32 aa, Artificial Sequence
  VH Framework 3 (FR3)
RLTISVDNSKSQFSFKMSSVTAQDTAVYYCAR

SEQ ID NO: 1324 - protein, 32 aa, Artificial Sequence
  VH Framework 3 (FR3)
RLTISVDNSKSQFSFKLSSLQAADTAVYYCAR

SEQ ID NO: 1325 - protein, 32 aa, Artificial Sequence
  VH Framework 3 (FR3)
RLTISVDNSKSQFSFKLSSLTAQDTAVYYCAR

SEQ ID NO: 1326 - protein, 32 aa, Artificial Sequence
  VH Framework 3 (FR3)
RLTISVDNSKSQFSFKLSSVQAQDTAVYYCAR

SEQ ID NO: 1327 - protein, 32 aa, Artificial Sequence
  VH Framework 3 (FR3)
RLTISVDNSKSQFSLKMSSLQAADTAVYYCAR

SEQ ID NO: 1328 - protein, 32 aa, Artificial Sequence
  VH Framework 3 (FR3)
RLTISVDNSKSQFSLKMSSLTAQDTAVYYCAR

SEQ ID NO: 1329 - protein, 32 aa, Artificial Sequence
  VH Framework 3 (FR3)
RLTISVDNSKSQFSLKMSSVQAQDTAVYYCAR

SEQ ID NO: 1330 - protein, 32 aa, Artificial Sequence
  VH Framework 3 (FR3)
RLTISVDNSKSQFSLKLSSLQAQDTAVYYCAR

SEQ ID NO: 1331 - protein, 32 aa, Artificial Sequence
  VH Framework 3 (FR3)
RLTISVDNSKNQVSFKMSSLTAADTAVYYCAR

SEQ ID NO: 1332 - protein, 32 aa, Artificial Sequence
  VH Framework 3 (FR3)
RLTISVDNSKNQVSFKMSSVQAADTAVYYCAR

SEQ ID NO: 1333 - protein, 32 aa, Artificial Sequence
  VH Framework 3 (FR3)
RLTISVDNSKNQVSFKMSSVTAQDTAVYYCAR

SEQ ID NO: 1334 - protein, 32 aa, Artificial Sequence
  VH Framework 3 (FR3)
RLTISVDNSKNQVSFKLSSLQAADTAVYYCAR

SEQ ID NO: 1335 - protein, 32 aa, Artificial Sequence
  VH Framework 3 (FR3)
RLTISVDNSKNQVSFKLSSLTAQDTAVYYCAR

SEQ ID NO: 1336 - protein, 32 aa, Artificial Sequence
  VH Framework 3 (FR3)
RLTISVDNSKNQVSFKLSSVQAQDTAVYYCAR

SEQ ID NO: 1337 - protein, 32 aa, Artificial Sequence
  VH Framework 3 (FR3)
RLTISVDNSKNQVSLKMSSLQAADTAVYYCAR

SEQ ID NO: 1338 - protein, 32 aa, Artificial Sequence
  VH Framework 3 (FR3)
RLTISVDNSKNQVSLKMSSLTAQDTAVYYCAR

SEQ ID NO: 1339 - protein, 32 aa, Artificial Sequence
  VH Framework 3 (FR3)
RLTISVDNSKNQVSLKMSSVQAQDTAVYYCAR

SEQ ID NO: 1340 - protein, 32 aa, Artificial Sequence
  VH Framework 3 (FR3)
RLTISVDNSKNQVSLKLSSLQAQDTAVYYCAR

SEQ ID NO: 1341 - protein, 32 aa, Artificial Sequence
  VH Framework 3 (FR3)
RLTISVDNSKNQFSFKMSSLQAADTAVYYCAR

SEQ ID NO: 1342 - protein, 32 aa, Artificial Sequence
  VH Framework 3 (FR3)
RLTISVDNSKNQFSFKMSSLTAQDTAVYYCAR

SEQ ID NO: 1343 - protein, 32 aa, Artificial Sequence
  VH Framework 3 (FR3)
RLTISVDNSKNQFSFKMSSVQAQDTAVYYCAR

SEQ ID NO: 1344 - protein, 32 aa, Artificial Sequence
  VH Framework 3 (FR3)
RLTISVDNSKNQFSFKLSSLQAQDTAVYYCAR

SEQ ID NO: 1345 - protein, 32 aa, Artificial Sequence
  VH Framework 3 (FR3)
RLTISVDNSKNQFSLKMSSLQAQDTAVYYCAR

SEQ ID NO: 1346 - protein, 32 aa, Artificial Sequence
  VH Framework 3 (FR3)
RLTISVDTSKSQVSFKMSSLTAADTAVYYCAR

SEQ ID NO: 1347 - protein, 32 aa, Artificial Sequence
  VH Framework 3 (FR3)
RLTISVDTSKSQVSFKMSSVQAADTAVYYCAR

SEQ ID NO: 1348 - protein, 32 aa, Artificial Sequence
  VH Framework 3 (FR3)
RLTISVDTSKSQVSFKMSSVTAQDTAVYYCAR

SEQ ID NO: 1349 - protein, 32 aa, Artificial Sequence
  VH Framework 3 (FR3)
RLTISVDTSKSQVSFKLSSLQAADTAVYYCAR

SEQ ID NO: 1350 - protein, 32 aa, Artificial Sequence
  VH Framework 3 (FR3)
RLTISVDTSKSQVSFKLSSLTAQDTAVYYCAR

SEQ ID NO: 1351 - protein, 32 aa, Artificial Sequence
  VH Framework 3 (FR3)
RLTISVDTSKSQVSFKLSSVQAQDTAVYYCAR

SEQ ID NO: 1352 - protein, 32 aa, Artificial Sequence
  VH Framework 3 (FR3)
RLTISVDTSKSQVSLKMSSLQAADTAVYYCAR

SEQ ID NO: 1353 - protein, 32 aa, Artificial Sequence
  VH Framework 3 (FR3)
RLTISVDTSKSQVSLKMSSLTAQDTAVYYCAR

SEQ ID NO: 1354 - protein, 32 aa, Artificial Sequence
  VH Framework 3 (FR3)
RLTISVDTSKSQVSLKMSSVQAQDTAVYYCAR

SEQ ID NO: 1355 - protein, 32 aa, Artificial Sequence
  VH Framework 3 (FR3)
RLTISVDTSKSQVSLKLSSLQAQDTAVYYCAR

SEQ ID NO: 1356 - protein, 32 aa, Artificial Sequence
  VH Framework 3 (FR3)
RLTISVDTSKSQFSFKMSSLQAADTAVYYCAR

SEQ ID NO: 1357 - protein, 32 aa, Artificial Sequence
  VH Framework 3 (FR3)
RLTISVDTSKSQFSFKMSSLTAQDTAVYYCAR

SEQ ID NO: 1358 - protein, 32 aa, Artificial Sequence
  VH Framework 3 (FR3)
RLTISVDTSKSQFSFKMSSVQAQDTAVYYCAR

SEQ ID NO: 1359 - protein, 32 aa, Artificial Sequence
  VH Framework 3 (FR3)
RLTISVDTSKSQFSFKLSSLQAQDTAVYYCAR

SEQ ID NO: 1360 - protein, 32 aa, Artificial Sequence
  VH Framework 3 (FR3)
RLTISVDTSKSQFSLKMSSLQAQDTAVYYCAR

SEQ ID NO: 1361 - protein, 32 aa, Artificial Sequence
  VH Framework 3 (FR3)
RLTISVDTSKNQVSFKMSSLQAADTAVYYCAR

SEQ ID NO: 1362 - protein, 32 aa, Artificial Sequence
  VH Framework 3 (FR3)
RLTISVDTSKNQVSFKMSSLTAQDTAVYYCAR

SEQ ID NO: 1363 - protein, 32 aa, Artificial Sequence
  VH Framework 3 (FR3)
RLTISVDTSKNQVSFKMSSVQAQDTAVYYCAR

SEQ ID NO: 1364 - protein, 32 aa, Artificial Sequence
  VH Framework 3 (FR3)
RLTISVDTSKNQVSFKLSSLQAQDTAVYYCAR

SEQ ID NO: 1365 - protein, 32 aa, Artificial Sequence
  VH Framework 3 (FR3)
RLTISVDTSKNQVSLKMSSLQAQDTAVYYCAR

SEQ ID NO: 1366 - protein, 32 aa, Artificial Sequence
  VH Framework 3 (FR3)
RLTISVDTSKNQFSFKMSSLQAQDTAVYYCAR

SEQ ID NO: 1367 - protein, 32 aa, Artificial Sequence
  VH Framework 3 (FR3)
RVTISKDNSKSQVSFKMSSVTAADTAVYYCAR

SEQ ID NO: 1368 - protein, 32 aa, Artificial Sequence
  VH Framework 3 (FR3)
RVTISKDNSKSQVSFKLSSLTAADTAVYYCAR

SEQ ID NO: 1369 - protein, 32 aa, Artificial Sequence
  VH Framework 3 (FR3)
RVTISKDNSKSQVSFKLSSVQAADTAVYYCAR

SEQ ID NO: 1370 - protein, 32 aa, Artificial Sequence
  VH Framework 3 (FR3)
RVTISKDNSKSQVSFKLSSVTAQDTAVYYCAR

SEQ ID NO: 1371 - protein, 32 aa, Artificial Sequence
  VH Framework 3 (FR3)
RVTISKDNSKSQVSLKMSSLTAADTAVYYCAR

SEQ ID NO: 1372 - protein, 32 aa, Artificial Sequence
  VH Framework 3 (FR3)
RVTISKDNSKSQVSLKMSSVQAADTAVYYCAR

SEQ ID NO: 1373 - protein, 32 aa, Artificial Sequence
  VH Framework 3 (FR3)
RVTISKDNSKSQVSLKMSSVTAQDTAVYYCAR

SEQ ID NO: 1374 - protein, 32 aa, Artificial Sequence
  VH Framework 3 (FR3)
RVTISKDNSKSQVSLKLSSLQAADTAVYYCAR

SEQ ID NO: 1375 - protein, 32 aa, Artificial Sequence
  VH Framework 3 (FR3)
RVTISKDNSKSQVSLKLSSLTAQDTAVYYCAR

SEQ ID NO: 1376 - protein, 32 aa, Artificial Sequence
  VH Framework 3 (FR3)
RVTISKDNSKSQVSLKLSSVQAQDTAVYYCAR

SEQ ID NO: 1377 - protein, 32 aa, Artificial Sequence
  VH Framework 3 (FR3)
RVTISKDNSKSQFSFKMSSLTAADTAVYYCAR

SEQ ID NO: 1378 - protein, 32 aa, Artificial Sequence
  VH Framework 3 (FR3)
RVTISKDNSKSQFSFKMSSVQAADTAVYYCAR

SEQ ID NO: 1379 - protein, 32 aa, Artificial Sequence
  VH Framework 3 (FR3)
RVTISKDNSKSQFSFKMSSVTAQDTAVYYCAR

SEQ ID NO: 1380 - protein, 32 aa, Artificial Sequence
  VH Framework 3 (FR3)
RVTISKDNSKSQFSFKLSSLQAADTAVYYCAR

SEQ ID NO: 1381 - protein, 32 aa, Artificial Sequence
  VH Framework 3 (FR3)
RVTISKDNSKSQFSFKLSSLTAQDTAVYYCAR

SEQ ID NO: 1382 - protein, 32 aa, Artificial Sequence
  VH Framework 3 (FR3)
RVTISKDNSKSQFSFKLSSVQAQDTAVYYCAR

SEQ ID NO: 1383 - protein, 32 aa, Artificial Sequence
  VH Framework 3 (FR3)
RVTISKDNSKSQFSLKMSSLQAADTAVYYCAR

SEQ ID NO: 1384 - protein, 32 aa, Artificial Sequence
  VH Framework 3 (FR3)
RVTISKDNSKSQFSLKMSSLTAQDTAVYYCAR

SEQ ID NO: 1385 - protein, 32 aa, Artificial Sequence
  VH Framework 3 (FR3)
RVTISKDNSKSQFSLKMSSVQAQDTAVYYCAR

SEQ ID NO: 1386 - protein, 32 aa, Artificial Sequence
  VH Framework 3 (FR3)
RVTISKDNSKSQFSLKLSSLQAQDTAVYYCAR

SEQ ID NO: 1387 - protein, 32 aa, Artificial Sequence
  VH Framework 3 (FR3)
RVTISKDNSKNQVSFKMSSLTAADTAVYYCAR

SEQ ID NO: 1388 - protein, 32 aa, Artificial Sequence
  VH Framework 3 (FR3)
RVTISKDNSKNQVSFKMSSVQAADTAVYYCAR

SEQ ID NO: 1389 - protein, 32 aa, Artificial Sequence
  VH Framework 3 (FR3)
RVTISKDNSKNQVSFKMSSVTAQDTAVYYCAR

SEQ ID NO: 1390 - protein, 32 aa, Artificial Sequence
  VH Framework 3 (FR3)
RVTISKDNSKNQVSFKLSSLQAADTAVYYCAR

SEQ ID NO: 1391 - protein, 32 aa, Artificial Sequence
  VH Framework 3 (FR3)
RVTISKDNSKNQVSFKLSSLTAQDTAVYYCAR

SEQ ID NO: 1392 - protein, 32 aa, Artificial Sequence
  VH Framework 3 (FR3)
RVTISKDNSKNQVSFKLSSVQAQDTAVYYCAR

SEQ ID NO: 1393 - protein, 32 aa, Artificial Sequence
  VH Framework 3 (FR3)
RVTISKDNSKNQVSLKMSSLQAADTAVYYCAR

SEQ ID NO: 1394 - protein, 32 aa, Artificial Sequence
  VH Framework 3 (FR3)
RVTISKDNSKNQVSLKMSSLTAQDTAVYYCAR

SEQ ID NO: 1395 - protein, 32 aa, Artificial Sequence
  VH Framework 3 (FR3)
RVTISKDNSKNQVSLKMSSVQAQDTAVYYCAR

SEQ ID NO: 1396 - protein, 32 aa, Artificial Sequence
  VH Framework 3 (FR3)
RVTISKDNSKNQVSLKLSSLQAQDTAVYYCAR

SEQ ID NO: 1397 - protein, 32 aa, Artificial Sequence
  VH Framework 3 (FR3)
RVTISKDNSKNQFSFKMSSLQAADTAVYYCAR

SEQ ID NO: 1398 - protein, 32 aa, Artificial Sequence
  VH Framework 3 (FR3)
RVTISKDNSKNQFSFKMSSLTAQDTAVYYCAR

SEQ ID NO: 1399 - protein, 32 aa, Artificial Sequence
  VH Framework 3 (FR3)
RVTISKDNSKNQFSFKMSSVQAQDTAVYYCAR

SEQ ID NO: 1400 - protein, 32 aa, Artificial Sequence
  VH Framework 3 (FR3)
RVTISKDNSKNQFSFKLSSLQAQDTAVYYCAR

SEQ ID NO: 1401 - protein, 32 aa, Artificial Sequence
  VH Framework 3 (FR3)
RVTISKDNSKNQFSLKMSSLQAQDTAVYYCAR

SEQ ID NO: 1402 - protein, 32 aa, Artificial Sequence
  VH Framework 3 (FR3)
RVTISKDTSKSQVSFKMSSLTAADTAVYYCAR

SEQ ID NO: 1403 - protein, 32 aa, Artificial Sequence
  VH Framework 3 (FR3)
RVTISKDTSKSQVSFKMSSVQAADTAVYYCAR

SEQ ID NO: 1404 - protein, 32 aa, Artificial Sequence
  VH Framework 3 (FR3)
RVTISKDTSKSQVSFKMSSVTAQDTAVYYCAR

SEQ ID NO: 1405 - protein, 32 aa, Artificial Sequence
  VH Framework 3 (FR3)
RVTISKDTSKSQVSFKLSSLQAADTAVYYCAR

SEQ ID NO: 1406 - protein, 32 aa, Artificial Sequence
  VH Framework 3 (FR3)
RVTISKDTSKSQVSFKLSSLTAQDTAVYYCAR

SEQ ID NO: 1407 - protein, 32 aa, Artificial Sequence
  VH Framework 3 (FR3)
RVTISKDTSKSQVSFKLSSVQAQDTAVYYCAR

SEQ ID NO: 1408 - protein, 32 aa, Artificial Sequence
  VH Framework 3 (FR3)
RVTISKDTSKSQVSLKMSSLQAADTAVYYCAR

SEQ ID NO: 1409 - protein, 32 aa, Artificial Sequence
  VH Framework 3 (FR3)
RVTISKDTSKSQVSLKMSSLTAQDTAVYYCAR

SEQ ID NO: 1410 - protein, 32 aa, Artificial Sequence
  VH Framework 3 (FR3)
RVTISKDTSKSQVSLKMSSVQAQDTAVYYCAR

SEQ ID NO: 1411 - protein, 32 aa, Artificial Sequence
  VH Framework 3 (FR3)
RVTISKDTSKSQVSLKLSSLQAQDTAVYYCAR

SEQ ID NO: 1412 - protein, 32 aa, Artificial Sequence
  VH Framework 3 (FR3)
RVTISKDTSKSQFSFKMSSLQAADTAVYYCAR

SEQ ID NO: 1413 - protein, 32 aa, Artificial Sequence
  VH Framework 3 (FR3)
RVTISKDTSKSQFSFKMSSLTAQDTAVYYCAR

SEQ ID NO: 1414 - protein, 32 aa, Artificial Sequence
  VH Framework 3 (FR3)
RVTISKDTSKSQFSFKMSSVQAQDTAVYYCAR

SEQ ID NO: 1415 - protein, 32 aa, Artificial Sequence
  VH Framework 3 (FR3)
RVTISKDTSKSQFSFKLSSLQAQDTAVYYCAR

SEQ ID NO: 1416 - protein, 32 aa, Artificial Sequence
  VH Framework 3 (FR3)
RVTISKDTSKSQFSLKMSSLQAQDTAVYYCAR

SEQ ID NO: 1417 - protein, 32 aa, Artificial Sequence
  VH Framework 3 (FR3)
RVTISKDTSKNQVSFKMSSLQAADTAVYYCAR

SEQ ID NO: 1418 - protein, 32 aa, Artificial Sequence
  VH Framework 3 (FR3)
RVTISKDTSKNQVSFKMSSLTAQDTAVYYCAR

SEQ ID NO: 1419 - protein, 32 aa, Artificial Sequence
  VH Framework 3 (FR3)
RVTISKDTSKNQVSFKMSSVQAQDTAVYYCAR

SEQ ID NO: 1420 - protein, 32 aa, Artificial Sequence
  VH Framework 3 (FR3)
RVTISKDTSKNQVSFKLSSLQAQDTAVYYCAR

SEQ ID NO: 1421 - protein, 32 aa, Artificial Sequence
  VH Framework 3 (FR3)
RVTISKDTSKNQVSLKMSSLQAQDTAVYYCAR

SEQ ID NO: 1422 - protein, 32 aa, Artificial Sequence
  VH Framework 3 (FR3)
RVTISKDTSKNQFSFKMSSLQAQDTAVYYCAR

SEQ ID NO: 1423 - protein, 32 aa, Artificial Sequence
  VH Framework 3 (FR3)
RVTISVDNSKSQVSFKMSSLTAADTAVYYCAR

SEQ ID NO: 1424 - protein, 32 aa, Artificial Sequence
  VH Framework 3 (FR3)
RVTISVDNSKSQVSFKMSSVQAADTAVYYCAR

SEQ ID NO: 1425 - protein, 32 aa, Artificial Sequence
  VH Framework 3 (FR3)
RVTISVDNSKSQVSFKMSSVTAQDTAVYYCAR

SEQ ID NO: 1426 - protein, 32 aa, Artificial Sequence
  VH Framework 3 (FR3)
RVTISVDNSKSQVSFKLSSLQAADTAVYYCAR

SEQ ID NO: 1427 - protein, 32 aa, Artificial Sequence
  VH Framework 3 (FR3)
RVTISVDNSKSQVSFKLSSLTAQDTAVYYCAR

SEQ ID NO: 1428 - protein, 32 aa, Artificial Sequence
  VH Framework 3 (FR3)
RVTISVDNSKSQVSFKLSSVQAQDTAVYYCAR

SEQ ID NO: 1429 - protein, 32 aa, Artificial Sequence
  VH Framework 3 (FR3)
RVTISVDNSKSQVSLKMSSLQAADTAVYYCAR

SEQ ID NO: 1430 - protein, 32 aa, Artificial Sequence
  VH Framework 3 (FR3)
RVTISVDNSKSQVSLKMSSLTAQDTAVYYCAR

SEQ ID NO: 1431 - protein, 32 aa, Artificial Sequence
  VH Framework 3 (FR3)
RVTISVDNSKSQVSLKMSSVQAQDTAVYYCAR

SEQ ID NO: 1432 - protein, 32 aa, Artificial Sequence
  VH Framework 3 (FR3)
RVTISVDNSKSQVSLKLSSLQAQDTAVYYCAR

SEQ ID NO: 1433 - protein, 32 aa, Artificial Sequence
  VH Framework 3 (FR3)
RVTISVDNSKSQFSFKMSSLQAADTAVYYCAR

SEQ ID NO: 1434 - protein, 32 aa, Artificial Sequence
  VH Framework 3 (FR3)
RVTISVDNSKSQFSFKMSSLTAQDTAVYYCAR

SEQ ID NO: 1435 - protein, 32 aa, Artificial Sequence
  VH Framework 3 (FR3)
RVTISVDNSKSQFSFKMSSVQAQDTAVYYCAR

SEQ ID NO: 1436 - protein, 32 aa, Artificial Sequence
  VH Framework 3 (FR3)
RVTISVDNSKSQFSFKLSSLQAQDTAVYYCAR

SEQ ID NO: 1437 - protein, 32 aa, Artificial Sequence
  VH Framework 3 (FR3)
RVTISVDNSKSQFSLKMSSLQAQDTAVYYCAR

SEQ ID NO: 1438 - protein, 32 aa, Artificial Sequence
  VH Framework 3 (FR3)
RVTISVDNSKNQVSFKMSSLQAADTAVYYCAR

SEQ ID NO: 1439 - protein, 32 aa, Artificial Sequence
  VH Framework 3 (FR3)
RVTISVDNSKNQVSFKMSSLTAQDTAVYYCAR

SEQ ID NO: 1440 - protein, 32 aa, Artificial Sequence
  VH Framework 3 (FR3)
RVTISVDNSKNQVSFKMSSVQAQDTAVYYCAR

SEQ ID NO: 1441 - protein, 32 aa, Artificial Sequence
  VH Framework 3 (FR3)
RVTISVDNSKNQVSFKLSSLQAQDTAVYYCAR

SEQ ID NO: 1442 - protein, 32 aa, Artificial Sequence
  VH Framework 3 (FR3)
RVTISVDNSKNQVSLKMSSLQAQDTAVYYCAR

SEQ ID NO: 1443 - protein, 32 aa, Artificial Sequence
  VH Framework 3 (FR3)
RVTISVDNSKNQFSFKMSSLQAQDTAVYYCAR

SEQ ID NO: 1444 - protein, 32 aa, Artificial Sequence
  VH Framework 3 (FR3)
RVTISVDTSKSQVSFKMSSLQAADTAVYYCAR

SEQ ID NO: 1445 - protein, 32 aa, Artificial Sequence
  VH Framework 3 (FR3)
RVTISVDTSKSQVSFKMSSLTAQDTAVYYCAR

SEQ ID NO: 1446 - protein, 32 aa, Artificial Sequence
  VH Framework 3 (FR3)
RVTISVDTSKSQVSFKMSSVQAQDTAVYYCAR

SEQ ID NO: 1447 - protein, 32 aa, Artificial Sequence
  VH Framework 3 (FR3)
RVTISVDTSKSQVSFKLSSLQAQDTAVYYCAR

SEQ ID NO: 1448 - protein, 32 aa, Artificial Sequence
  VH Framework 3 (FR3)
RVTISVDTSKSQVSLKMSSLQAQDTAVYYCAR

SEQ ID NO: 1449 - protein, 32 aa, Artificial Sequence
  VH Framework 3 (FR3)
RVTISVDTSKSQFSFKMSSLQAQDTAVYYCAR

SEQ ID NO: 1450 - protein, 32 aa, Artificial Sequence
  VH Framework 3 (FR3)
RVTISVDTSKNQVSFKMSSLQAQDTAVYYCAR

SEQ ID NO: 1451 - protein, 32 aa, Artificial Sequence
  VH Framework 3 (FR3)
RLTISKDNSKSQVSFKMSSVTAADTAVYYCAR

SEQ ID NO: 1452 - protein, 32 aa, Artificial Sequence
  VH Framework 3 (FR3)
RLTISKDNSKSQVSFKLSSLTAADTAVYYCAR

SEQ ID NO: 1453 - protein, 32 aa, Artificial Sequence
  VH Framework 3 (FR3)
RLTISKDNSKSQVSFKLSSVQAADTAVYYCAR

SEQ ID NO: 1454 - protein, 32 aa, Artificial Sequence
  VH Framework 3 (FR3)
RLTISKDNSKSQVSFKLSSVTAQDTAVYYCAR

SEQ ID NO: 1455 - protein, 32 aa, Artificial Sequence
  VH Framework 3 (FR3)
RLTISKDNSKSQVSLKMSSLTAADTAVYYCAR

SEQ ID NO: 1456 - protein, 32 aa, Artificial Sequence
  VH Framework 3 (FR3)
RLTISKDNSKSQVSLKMSSVQAADTAVYYCAR

SEQ ID NO: 1457 - protein, 32 aa, Artificial Sequence
  VH Framework 3 (FR3)
RLTISKDNSKSQVSLKMSSVTAQDTAVYYCAR

SEQ ID NO: 1458 - protein, 32 aa, Artificial Sequence
  VH Framework 3 (FR3)
RLTISKDNSKSQVSLKLSSLQAADTAVYYCAR

SEQ ID NO: 1459 - protein, 32 aa, Artificial Sequence
  VH Framework 3 (FR3)
RLTISKDNSKSQVSLKLSSLTAQDTAVYYCAR

SEQ ID NO: 1460 - protein, 32 aa, Artificial Sequence
  VH Framework 3 (FR3)
RLTISKDNSKSQVSLKLSSVQAQDTAVYYCAR

SEQ ID NO: 1461 - protein, 32 aa, Artificial Sequence
  VH Framework 3 (FR3)
RLTISKDNSKSQFSFKMSSLTAADTAVYYCAR

SEQ ID NO: 1462 - protein, 32 aa, Artificial Sequence
  VH Framework 3 (FR3)
RLTISKDNSKSQFSFKMSSVQAADTAVYYCAR

SEQ ID NO: 1463 - protein, 32 aa, Artificial Sequence
  VH Framework 3 (FR3)
RLTISKDNSKSQFSFKMSSVTAQDTAVYYCAR

SEQ ID NO: 1464 - protein, 32 aa, Artificial Sequence
  VH Framework 3 (FR3)
RLTISKDNSKSQFSFKLSSLQAADTAVYYCAR

SEQ ID NO: 1465 - protein, 32 aa, Artificial Sequence
  VH Framework 3 (FR3)
RLTISKDNSKSQFSFKLSSLTAQDTAVYYCAR

SEQ ID NO: 1466 - protein, 32 aa, Artificial Sequence
  VH Framework 3 (FR3)
RLTISKDNSKSQFSFKLSSVQAQDTAVYYCAR

SEQ ID NO: 1467 - protein, 32 aa, Artificial Sequence
  VH Framework 3 (FR3)
RLTISKDNSKSQFSLKMSSLQAADTAVYYCAR

SEQ ID NO: 1468 - protein, 32 aa, Artificial Sequence
  VH Framework 3 (FR3)
RLTISKDNSKSQFSLKMSSLTAQDTAVYYCAR

SEQ ID NO: 1469 - protein, 32 aa, Artificial Sequence
  VH Framework 3 (FR3)
RLTISKDNSKSQFSLKMSSVQAQDTAVYYCAR

SEQ ID NO: 1470 - protein, 32 aa, Artificial Sequence
  VH Framework 3 (FR3)
RLTISKDNSKSQFSLKLSSLQAQDTAVYYCAR

SEQ ID NO: 1471 - protein, 32 aa, Artificial Sequence
  VH Framework 3 (FR3)
RLTISKDNSKNQVSFKMSSLTAADTAVYYCAR

SEQ ID NO: 1472 - protein, 32 aa, Artificial Sequence
  VH Framework 3 (FR3)
RLTISKDNSKNQVSFKMSSVQAADTAVYYCAR

SEQ ID NO: 1473 - protein, 32 aa, Artificial Sequence
  VH Framework 3 (FR3)
RLTISKDNSKNQVSFKMSSVTAQDTAVYYCAR

SEQ ID NO: 1474 - protein, 32 aa, Artificial Sequence
  VH Framework 3 (FR3)
RLTISKDNSKNQVSFKLSSLQAADTAVYYCAR

SEQ ID NO: 1475 - protein, 32 aa, Artificial Sequence
  VH Framework 3 (FR3)
RLTISKDNSKNQVSFKLSSLTAQDTAVYYCAR

SEQ ID NO: 1476 - protein, 32 aa, Artificial Sequence
  VH Framework 3 (FR3)
RLTISKDNSKNQVSFKLSSVQAQDTAVYYCAR

SEQ ID NO: 1477 - protein, 32 aa, Artificial Sequence
  VH Framework 3 (FR3)
RLTISKDNSKNQVSLKMSSLQAADTAVYYCAR

SEQ ID NO: 1478 - protein, 32 aa, Artificial Sequence
  VH Framework 3 (FR3)
RLTISKDNSKNQVSLKMSSLTAQDTAVYYCAR

SEQ ID NO: 1479 - protein, 32 aa, Artificial Sequence
  VH Framework 3 (FR3)
RLTISKDNSKNQVSLKMSSVQAQDTAVYYCAR

SEQ ID NO: 1480 - protein, 32 aa, Artificial Sequence
  VH Framework 3 (FR3)
RLTISKDNSKNQVSLKLSSLQAQDTAVYYCAR

SEQ ID NO: 1481 - protein, 32 aa, Artificial Sequence
  VH Framework 3 (FR3)
RLTISKDNSKNQFSFKMSSLQAADTAVYYCAR

SEQ ID NO: 1482 - protein, 32 aa, Artificial Sequence
  VH Framework 3 (FR3)
RLTISKDNSKNQFSFKMSSLTAQDTAVYYCAR

SEQ ID NO: 1483 - protein, 32 aa, Artificial Sequence
  VH Framework 3 (FR3)
RLTISKDNSKNQFSFKMSSVQAQDTAVYYCAR

SEQ ID NO: 1484 - protein, 32 aa, Artificial Sequence
  VH Framework 3 (FR3)
RLTISKDNSKNQFSFKLSSLQAQDTAVYYCAR

SEQ ID NO: 1485 - protein, 32 aa, Artificial Sequence
  VH Framework 3 (FR3)
RLTISKDNSKNQFSLKMSSLQAQDTAVYYCAR

SEQ ID NO: 1486 - protein, 32 aa, Artificial Sequence
  VH Framework 3 (FR3)
RLTISKDTSKSQVSFKMSSLTAADTAVYYCAR

SEQ ID NO: 1487 - protein, 32 aa, Artificial Sequence
  VH Framework 3 (FR3)
RLTISKDTSKSQVSFKMSSVQAADTAVYYCAR

SEQ ID NO: 1488 - protein, 32 aa, Artificial Sequence
  VH Framework 3 (FR3)
RLTISKDTSKSQVSFKMSSVTAQDTAVYYCAR

SEQ ID NO: 1489 - protein, 32 aa, Artificial Sequence
  VH Framework 3 (FR3)
RLTISKDTSKSQVSFKLSSLQAADTAVYYCAR

SEQ ID NO: 1490 - protein, 32 aa, Artificial Sequence
  VH Framework 3 (FR3)
RLTISKDTSKSQVSFKLSSLTAQDTAVYYCAR

SEQ ID NO: 1491 - protein, 32 aa, Artificial Sequence
  VH Framework 3 (FR3)
RLTISKDTSKSQVSFKLSSVQAQDTAVYYCAR

SEQ ID NO: 1492 - protein, 32 aa, Artificial Sequence
  VH Framework 3 (FR3)
RLTISKDTSKSQVSLKMSSLQAADTAVYYCAR

SEQ ID NO: 1493 - protein, 32 aa, Artificial Sequence
  VH Framework 3 (FR3)
RLTISKDTSKSQVSLKMSSLTAQDTAVYYCAR

SEQ ID NO: 1494 - protein, 32 aa, Artificial Sequence
  VH Framework 3 (FR3)
RLTISKDTSKSQVSLKMSSVQAQDTAVYYCAR

SEQ ID NO: 1495 - protein, 32 aa, Artificial Sequence
  VH Framework 3 (FR3)
RLTISKDTSKSQVSLKLSSLQAQDTAVYYCAR

SEQ ID NO: 1496 - protein, 32 aa, Artificial Sequence
  VH Framework 3 (FR3)
RLTISKDTSKSQFSFKMSSLQAADTAVYYCAR

SEQ ID NO: 1497 - protein, 32 aa, Artificial Sequence
  VH Framework 3 (FR3)
RLTISKDTSKSQFSFKMSSLTAQDTAVYYCAR

SEQ ID NO: 1498 - protein, 32 aa, Artificial Sequence
  VH Framework 3 (FR3)
RLTISKDTSKSQFSFKMSSVQAQDTAVYYCAR

SEQ ID NO: 1499 - protein, 32 aa, Artificial Sequence
  VH Framework 3 (FR3)
RLTISKDTSKSQFSFKLSSLQAQDTAVYYCAR

SEQ ID NO: 1500 - protein, 32 aa, Artificial Sequence
  VH Framework 3 (FR3)
RLTISKDTSKSQFSLKMSSLQAQDTAVYYCAR

SEQ ID NO: 1501 - protein, 32 aa, Artificial Sequence
  VH Framework 3 (FR3)
RLTISKDTSKNQVSFKMSSLQAADTAVYYCAR

SEQ ID NO: 1502 - protein, 32 aa, Artificial Sequence
  VH Framework 3 (FR3)
RLTISKDTSKNQVSFKMSSLTAQDTAVYYCAR

SEQ ID NO: 1503 - protein, 32 aa, Artificial Sequence
  VH Framework 3 (FR3)
RLTISKDTSKNQVSFKMSSVQAQDTAVYYCAR

SEQ ID NO: 1504 - protein, 32 aa, Artificial Sequence
  VH Framework 3 (FR3)
RLTISKDTSKNQVSFKLSSLQAQDTAVYYCAR

SEQ ID NO: 1505 - protein, 32 aa, Artificial Sequence
  VH Framework 3 (FR3)
RLTISKDTSKNQVSLKMSSLQAQDTAVYYCAR

SEQ ID NO: 1506 - protein, 32 aa, Artificial Sequence
  VH Framework 3 (FR3)
RLTISKDTSKNQFSFKMSSLQAQDTAVYYCAR

SEQ ID NO: 1507 - protein, 32 aa, Artificial Sequence
  VH Framework 3 (FR3)
RLTISVDNSKSQVSFKMSSLTAADTAVYYCAR

SEQ ID NO: 1508 - protein, 32 aa, Artificial Sequence
  VH Framework 3 (FR3)
RLTISVDNSKSQVSFKMSSVQAADTAVYYCAR

SEQ ID NO: 1509 - protein, 32 aa, Artificial Sequence
  VH Framework 3 (FR3)
RLTISVDNSKSQVSFKMSSVTAQDTAVYYCAR

SEQ ID NO: 1510 - protein, 32 aa, Artificial Sequence
  VH Framework 3 (FR3)
RLTISVDNSKSQVSFKLSSLQAADTAVYYCAR

SEQ ID NO: 1511 - protein, 32 aa, Artificial Sequence
  VH Framework 3 (FR3)
RLTISVDNSKSQVSFKLSSLTAQDTAVYYCAR

SEQ ID NO: 1512 - protein, 32 aa, Artificial Sequence
  VH Framework 3 (FR3)
RLTISVDNSKSQVSFKLSSVQAQDTAVYYCAR

SEQ ID NO: 1513 - protein, 32 aa, Artificial Sequence
  VH Framework 3 (FR3)
RLTISVDNSKSQVSLKMSSLQAADTAVYYCAR

SEQ ID NO: 1514 - protein, 32 aa, Artificial Sequence
  VH Framework 3 (FR3)
RLTISVDNSKSQVSLKMSSLTAQDTAVYYCAR

SEQ ID NO: 1515 - protein, 32 aa, Artificial Sequence
  VH Framework 3 (FR3)
RLTISVDNSKSQVSLKMSSVQAQDTAVYYCAR

SEQ ID NO: 1516 - protein, 32 aa, Artificial Sequence
  VH Framework 3 (FR3)
RLTISVDNSKSQVSLKLSSLQAQDTAVYYCAR

SEQ ID NO: 1517 - protein, 32 aa, Artificial Sequence
  VH Framework 3 (FR3)
RLTISVDNSKSQFSFKMSSLQAADTAVYYCAR

SEQ ID NO: 1518 - protein, 32 aa, Artificial Sequence
  VH Framework 3 (FR3)
RLTISVDNSKSQFSFKMSSLTAQDTAVYYCAR

SEQ ID NO: 1519 - protein, 32 aa, Artificial Sequence
  VH Framework 3 (FR3)
RLTISVDNSKSQFSFKMSSVQAQDTAVYYCAR

SEQ ID NO: 1520 - protein, 32 aa, Artificial Sequence
  VH Framework 3 (FR3)
RLTISVDNSKSQFSFKLSSLQAQDTAVYYCAR

SEQ ID NO: 1521 - protein, 32 aa, Artificial Sequence
  VH Framework 3 (FR3)
RLTISVDNSKSQFSLKMSSLQAQDTAVYYCAR

SEQ ID NO: 1522 - protein, 32 aa, Artificial Sequence
  VH Framework 3 (FR3)
RLTISVDNSKNQVSFKMSSLQAADTAVYYCAR

SEQ ID NO: 1523 - protein, 32 aa, Artificial Sequence
  VH Framework 3 (FR3)
RLTISVDNSKNQVSFKMSSLTAQDTAVYYCAR

SEQ ID NO: 1524 - protein, 32 aa, Artificial Sequence
  VH Framework 3 (FR3)
RLTISVDNSKNQVSFKMSSVQAQDTAVYYCAR

SEQ ID NO: 1525 - protein, 32 aa, Artificial Sequence
  VH Framework 3 (FR3)
RLTISVDNSKNQVSFKLSSLQAQDTAVYYCAR

SEQ ID NO: 1526 - protein, 32 aa, Artificial Sequence
  VH Framework 3 (FR3)
RLTISVDNSKNQVSLKMSSLQAQDTAVYYCAR

SEQ ID NO: 1527 - protein, 32 aa, Artificial Sequence
  VH Framework 3 (FR3)
RLTISVDNSKNQFSFKMSSLQAQDTAVYYCAR

SEQ ID NO: 1528 - protein, 32 aa, Artificial Sequence
  VH Framework 3 (FR3)
RLTISVDTSKSQVSFKMSSLQAADTAVYYCAR

SEQ ID NO: 1529 - protein, 32 aa, Artificial Sequence
  VH Framework 3 (FR3)
RLTISVDTSKSQVSFKMSSLTAQDTAVYYCAR

SEQ ID NO: 1530 - protein, 32 aa, Artificial Sequence
  VH Framework 3 (FR3)
RLTISVDTSKSQVSFKMSSVQAQDTAVYYCAR

SEQ ID NO: 1531 - protein, 32 aa, Artificial Sequence
  VH Framework 3 (FR3)
RLTISVDTSKSQVSFKLSSLQAQDTAVYYCAR

SEQ ID NO: 1532 - protein, 32 aa, Artificial Sequence
  VH Framework 3 (FR3)
RLTISVDTSKSQVSLKMSSLQAQDTAVYYCAR

SEQ ID NO: 1533 - protein, 32 aa, Artificial Sequence
  VH Framework 3 (FR3)
RLTISVDTSKSQFSFKMSSLQAQDTAVYYCAR

SEQ ID NO: 1534 - protein, 32 aa, Artificial Sequence
  VH Framework 3 (FR3)
RLTISVDTSKNQVSFKMSSLQAQDTAVYYCAR

SEQ ID NO: 1535 - protein, 32 aa, Artificial Sequence
  VH Framework 3 (FR3)
RVTISKDNSKSQVSFKMSSLTAADTAVYYCAR

SEQ ID NO: 1536 - protein, 32 aa, Artificial Sequence
  VH Framework 3 (FR3)
RVTISKDNSKSQVSFKMSSVQAADTAVYYCAR

SEQ ID NO: 1537 - protein, 32 aa, Artificial Sequence
  VH Framework 3 (FR3)
RVTISKDNSKSQVSFKMSSVTAQDTAVYYCAR

SEQ ID NO: 1538 - protein, 32 aa, Artificial Sequence
  VH Framework 3 (FR3)
RVTISKDNSKSQVSFKLSSLQAADTAVYYCAR

SEQ ID NO: 1539 - protein, 32 aa, Artificial Sequence
  VH Framework 3 (FR3)
RVTISKDNSKSQVSFKLSSLTAQDTAVYYCAR

SEQ ID NO: 1540 - protein, 32 aa, Artificial Sequence
  VH Framework 3 (FR3)
RVTISKDNSKSQVSFKLSSVQAQDTAVYYCAR

SEQ ID NO: 1541 - protein, 32 aa, Artificial Sequence
  VH Framework 3 (FR3)
RVTISKDNSKSQVSLKMSSLQAADTAVYYCAR

SEQ ID NO: 1542 - protein, 32 aa, Artificial Sequence
  VH Framework 3 (FR3)
RVTISKDNSKSQVSLKMSSLTAQDTAVYYCAR

SEQ ID NO: 1543 - protein, 32 aa, Artificial Sequence
  VH Framework 3 (FR3)
RVTISKDNSKSQVSLKMSSVQAQDTAVYYCAR

SEQ ID NO: 1544 - protein, 32 aa, Artificial Sequence
  VH Framework 3 (FR3)
RVTISKDNSKSQVSLKLSSLQAQDTAVYYCAR

SEQ ID NO: 1545 - protein, 32 aa, Artificial Sequence
  VH Framework 3 (FR3)
RVTISKDNSKSQFSFKMSSLQAADTAVYYCAR

SEQ ID NO: 1546 - protein, 32 aa, Artificial Sequence
  VH Framework 3 (FR3)
RVTISKDNSKSQFSFKMSSLTAQDTAVYYCAR

SEQ ID NO: 1547 - protein, 32 aa, Artificial Sequence
  VH Framework 3 (FR3)
RVTISKDNSKSQFSFKMSSVQAQDTAVYYCAR

SEQ ID NO: 1548 - protein, 32 aa, Artificial Sequence
  VH Framework 3 (FR3)
RVTISKDNSKSQFSFKLSSLQAQDTAVYYCAR

SEQ ID NO: 1549 - protein, 32 aa, Artificial Sequence
  VH Framework 3 (FR3)
RVTISKDNSKSQFSLKMSSLQAQDTAVYYCAR

SEQ ID NO: 1550 - protein, 32 aa, Artificial Sequence
  VH Framework 3 (FR3)
RVTISKDNSKNQVSFKMSSLQAADTAVYYCAR

SEQ ID NO: 1551 - protein, 32 aa, Artificial Sequence
  VH Framework 3 (FR3)
RVTISKDNSKNQVSFKMSSLTAQDTAVYYCAR

SEQ ID NO: 1552 - protein, 32 aa, Artificial Sequence
  VH Framework 3 (FR3)
RVTISKDNSKNQVSFKMSSVQAQDTAVYYCAR

SEQ ID NO: 1553 - protein, 32 aa, Artificial Sequence
  VH Framework 3 (FR3)
RVTISKDNSKNQVSFKLSSLQAQDTAVYYCAR

SEQ ID NO: 1554 - protein, 32 aa, Artificial Sequence
  VH Framework 3 (FR3)
RVTISKDNSKNQVSLKMSSLQAQDTAVYYCAR

SEQ ID NO: 1555 - protein, 32 aa, Artificial Sequence
  VH Framework 3 (FR3)
RVTISKDNSKNQFSFKMSSLQAQDTAVYYCAR

SEQ ID NO: 1556 - protein, 32 aa, Artificial Sequence
  VH Framework 3 (FR3)
RVTISKDTSKSQVSFKMSSLQAADTAVYYCAR

SEQ ID NO: 1557 - protein, 32 aa, Artificial Sequence
  VH Framework 3 (FR3)
RVTISKDTSKSQVSFKMSSLTAQDTAVYYCAR

SEQ ID NO: 1558 - protein, 32 aa, Artificial Sequence
  VH Framework 3 (FR3)
RVTISKDTSKSQVSFKMSSVQAQDTAVYYCAR

SEQ ID NO: 1559 - protein, 32 aa, Artificial Sequence
  VH Framework 3 (FR3)
RVTISKDTSKSQVSFKLSSLQAQDTAVYYCAR

SEQ ID NO: 1560 - protein, 32 aa, Artificial Sequence
  VH Framework 3 (FR3)
RVTISKDTSKSQVSLKMSSLQAQDTAVYYCAR

SEQ ID NO: 1561 - protein, 32 aa, Artificial Sequence
  VH Framework 3 (FR3)
RVTISKDTSKSQFSFKMSSLQAQDTAVYYCAR

SEQ ID NO: 1562 - protein, 32 aa, Artificial Sequence
  VH Framework 3 (FR3)
RVTISKDTSKNQVSFKMSSLQAQDTAVYYCAR

SEQ ID NO: 1563 - protein, 32 aa, Artificial Sequence
  VH Framework 3 (FR3)
RVTISVDNSKSQVSFKMSSLQAADTAVYYCAR

SEQ ID NO: 1564 - protein, 32 aa, Artificial Sequence
  VH Framework 3 (FR3)
RVTISVDNSKSQVSFKMSSLTAQDTAVYYCAR

SEQ ID NO: 1565 - protein, 32 aa, Artificial Sequence
  VH Framework 3 (FR3)
RVTISVDNSKSQVSFKMSSVQAQDTAVYYCAR

SEQ ID NO: 1566 - protein, 32 aa, Artificial Sequence
  VH Framework 3 (FR3)
RVTISVDNSKSQVSFKLSSLQAQDTAVYYCAR

SEQ ID NO: 1567 - protein, 32 aa, Artificial Sequence
  VH Framework 3 (FR3)
RVTISVDNSKSQVSLKMSSLQAQDTAVYYCAR

SEQ ID NO: 1568 - protein, 32 aa, Artificial Sequence
  VH Framework 3 (FR3)
RVTISVDNSKSQFSFKMSSLQAQDTAVYYCAR

SEQ ID NO: 1569 - protein, 32 aa, Artificial Sequence
  VH Framework 3 (FR3)
RVTISVDNSKNQVSFKMSSLQAQDTAVYYCAR

SEQ ID NO: 1570 - protein, 32 aa, Artificial Sequence
  VH Framework 3 (FR3)
RVTISVDTSKSQVSFKMSSLQAQDTAVYYCAR

SEQ ID NO: 1571 - protein, 32 aa, Artificial Sequence
  VH Framework 3 (FR3)
RLTISKDNSKSQVSFKMSSLTAADTAVYYCAR

SEQ ID NO: 1572 - protein, 32 aa, Artificial Sequence
  VH Framework 3 (FR3)
RLTISKDNSKSQVSFKMSSVQAADTAVYYCAR

SEQ ID NO: 1573 - protein, 32 aa, Artificial Sequence
  VH Framework 3 (FR3)
RLTISKDNSKSQVSFKMSSVTAQDTAVYYCAR

SEQ ID NO: 1574 - protein, 32 aa, Artificial Sequence
  VH Framework 3 (FR3)
RLTISKDNSKSQVSFKLSSLQAADTAVYYCAR

SEQ ID NO: 1575 - protein, 32 aa, Artificial Sequence
  VH Framework 3 (FR3)
RLTISKDNSKSQVSFKLSSLTAQDTAVYYCAR

SEQ ID NO: 1576 - protein, 32 aa, Artificial Sequence
  VH Framework 3 (FR3)
RLTISKDNSKSQVSFKLSSVQAQDTAVYYCAR

SEQ ID NO: 1577 - protein, 32 aa, Artificial Sequence
  VH Framework 3 (FR3)
RLTISKDNSKSQVSLKMSSLQAADTAVYYCAR

SEQ ID NO: 1578 - protein, 32 aa, Artificial Sequence
  VH Framework 3 (FR3)
RLTISKDNSKSQVSLKMSSLTAQDTAVYYCAR

SEQ ID NO: 1579 - protein, 32 aa, Artificial Sequence
  VH Framework 3 (FR3)
RLTISKDNSKSQVSLKMSSVQAQDTAVYYCAR

SEQ ID NO: 1580 - protein, 32 aa, Artificial Sequence
  VH Framework 3 (FR3)
RLTISKDNSKSQVSLKLSSLQAQDTAVYYCAR

SEQ ID NO: 1581 - protein, 32 aa, Artificial Sequence
  VH Framework 3 (FR3)
RLTISKDNSKSQFSFKMSSLQAADTAVYYCAR

SEQ ID NO: 1582 - protein, 32 aa, Artificial Sequence
  VH Framework 3 (FR3)
RLTISKDNSKSQFSFKMSSLTAQDTAVYYCAR

SEQ ID NO: 1583 - protein, 32 aa, Artificial Sequence
  VH Framework 3 (FR3)
RLTISKDNSKSQFSFKMSSVQAQDTAVYYCAR

SEQ ID NO: 1584 - protein, 32 aa, Artificial Sequence
  VH Framework 3 (FR3)
RLTISKDNSKSQFSFKLSSLQAQDTAVYYCAR

SEQ ID NO: 1585 - protein, 32 aa, Artificial Sequence
  VH Framework 3 (FR3)
RLTISKDNSKSQFSLKMSSLQAQDTAVYYCAR

SEQ ID NO: 1586 - protein, 32 aa, Artificial Sequence
  VH Framework 3 (FR3)
RLTISKDNSKNQVSFKMSSLQAADTAVYYCAR

SEQ ID NO: 1587 - protein, 32 aa, Artificial Sequence
  VH Framework 3 (FR3)
RLTISKDNSKNQVSFKMSSLTAQDTAVYYCAR

SEQ ID NO: 1588 - protein, 32 aa, Artificial Sequence
  VH Framework 3 (FR3)
RLTISKDNSKNQVSFKMSSVQAQDTAVYYCAR

SEQ ID NO: 1589 - protein, 32 aa, Artificial Sequence
  VH Framework 3 (FR3)
RLTISKDNSKNQVSFKLSSLQAQDTAVYYCAR

SEQ ID NO: 1590 - protein, 32 aa, Artificial Sequence
  VH Framework 3 (FR3)
RLTISKDNSKNQVSLKMSSLQAQDTAVYYCAR

SEQ ID NO: 1591 - protein, 32 aa, Artificial Sequence
  VH Framework 3 (FR3)
RLTISKDNSKNQFSFKMSSLQAQDTAVYYCAR

SEQ ID NO: 1592 - protein, 32 aa, Artificial Sequence
  VH Framework 3 (FR3)
RLTISKDTSKSQVSFKMSSLQAADTAVYYCAR

SEQ ID NO: 1593 - protein, 32 aa, Artificial Sequence
  VH Framework 3 (FR3)
RLTISKDTSKSQVSFKMSSLTAQDTAVYYCAR

SEQ ID NO: 1594 - protein, 32 aa, Artificial Sequence
  VH Framework 3 (FR3)
RLTISKDTSKSQVSFKMSSVQAQDTAVYYCAR

SEQ ID NO: 1595 - protein, 32 aa, Artificial Sequence
  VH Framework 3 (FR3)
RLTISKDTSKSQVSFKLSSLQAQDTAVYYCAR

SEQ ID NO: 1596 - protein, 32 aa, Artificial Sequence
  VH Framework 3 (FR3)
RLTISKDTSKSQVSLKMSSLQAQDTAVYYCAR

SEQ ID NO: 1597 - protein, 32 aa, Artificial Sequence
  VH Framework 3 (FR3)
RLTISKDTSKSQFSFKMSSLQAQDTAVYYCAR

SEQ ID NO: 1598 - protein, 32 aa, Artificial Sequence
  VH Framework 3 (FR3)
RLTISKDTSKNQVSFKMSSLQAQDTAVYYCAR

SEQ ID NO: 1599 - protein, 32 aa, Artificial Sequence
  VH Framework 3 (FR3)
RLTISVDNSKSQVSFKMSSLQAADTAVYYCAR

SEQ ID NO: 1600 - protein, 32 aa, Artificial Sequence
  VH Framework 3 (FR3)
RLTISVDNSKSQVSFKMSSLTAQDTAVYYCAR

SEQ ID NO: 1601 - protein, 32 aa, Artificial Sequence
  VH Framework 3 (FR3)
RLTISVDNSKSQVSFKMSSVQAQDTAVYYCAR

SEQ ID NO: 1602 - protein, 32 aa, Artificial Sequence
  VH Framework 3 (FR3)
RLTISVDNSKSQVSFKLSSLQAQDTAVYYCAR

SEQ ID NO: 1603 - protein, 32 aa, Artificial Sequence
  VH Framework 3 (FR3)
RLTISVDNSKSQVSLKMSSLQAQDTAVYYCAR

SEQ ID NO: 1604 - protein, 32 aa, Artificial Sequence
  VH Framework 3 (FR3)
RLTISVDNSKSQFSFKMSSLQAQDTAVYYCAR

SEQ ID NO: 1605 - protein, 32 aa, Artificial Sequence
  VH Framework 3 (FR3)
RLTISVDNSKNQVSFKMSSLQAQDTAVYYCAR

SEQ ID NO: 1606 - protein, 32 aa, Artificial Sequence
  VH Framework 3 (FR3)
RLTISVDTSKSQVSFKMSSLQAQDTAVYYCAR

SEQ ID NO: 1607 - protein, 32 aa, Artificial Sequence
  VH Framework 3 (FR3)
RVTISKDNSKSQVSFKMSSLQAADTAVYYCAR

SEQ ID NO: 1608 - protein, 32 aa, Artificial Sequence
  VH Framework 3 (FR3)
RVTISKDNSKSQVSFKMSSLTAQDTAVYYCAR

SEQ ID NO: 1609 - protein, 32 aa, Artificial Sequence
  VH Framework 3 (FR3)
RVTISKDNSKSQVSFKMSSVQAQDTAVYYCAR

SEQ ID NO: 1610 - protein, 32 aa, Artificial Sequence
  VH Framework 3 (FR3)
RVTISKDNSKSQVSFKLSSLQAQDTAVYYCAR

SEQ ID NO: 1611 - protein, 32 aa, Artificial Sequence
  VH Framework 3 (FR3)
RVTISKDNSKSQVSLKMSSLQAQDTAVYYCAR

SEQ ID NO: 1612 - protein, 32 aa, Artificial Sequence
  VH Framework 3 (FR3)
RVTISKDNSKSQFSFKMSSLQAQDTAVYYCAR

SEQ ID NO: 1613 - protein, 32 aa, Artificial Sequence
  VH Framework 3 (FR3)
RVTISKDNSKNQVSFKMSSLQAQDTAVYYCAR

SEQ ID NO: 1614 - protein, 32 aa, Artificial Sequence
  VH Framework 3 (FR3)
RVTISKDTSKSQVSFKMSSLQAQDTAVYYCAR

SEQ ID NO: 1615 - protein, 32 aa, Artificial Sequence
  VH Framework 3 (FR3)
RVTISVDNSKSQVSFKMSSLQAQDTAVYYCAR

SEQ ID NO: 1616 - protein, 32 aa, Artificial Sequence
  VH Framework 3 (FR3)
RLTISKDNSKSQVSFKMSSLQAADTAVYYCAR

SEQ ID NO: 1617 - protein, 32 aa, Artificial Sequence
  VH Framework 3 (FR3)
RLTISKDNSKSQVSFKMSSLTAQDTAVYYCAR

SEQ ID NO: 1618 - protein, 32 aa, Artificial Sequence
  VH Framework 3 (FR3)
RLTISKDNSKSQVSFKMSSVQAQDTAVYYCAR

SEQ ID NO: 1619 - protein, 32 aa, Artificial Sequence
  VH Framework 3 (FR3)
RLTISKDNSKSQVSFKLSSLQAQDTAVYYCAR

SEQ ID NO: 1620 - protein, 32 aa, Artificial Sequence
  VH Framework 3 (FR3)
RLTISKDNSKSQVSLKMSSLQAQDTAVYYCAR

SEQ ID NO: 1621 - protein, 32 aa, Artificial Sequence
  VH Framework 3 (FR3)
RLTISKDNSKSQFSFKMSSLQAQDTAVYYCAR

SEQ ID NO: 1622 - protein, 32 aa, Artificial Sequence
  VH Framework 3 (FR3)
RLTISKDNSKNQVSFKMSSLQAQDTAVYYCAR

SEQ ID NO: 1623 - protein, 32 aa, Artificial Sequence
  VH Framework 3 (FR3)
RLTISKDTSKSQVSFKMSSLQAQDTAVYYCAR

SEQ ID NO: 1624 - protein, 32 aa, Artificial Sequence
  VH Framework 3 (FR3)
RLTISVDNSKSQVSFKMSSLQAQDTAVYYCAR

SEQ ID NO: 1625 - protein, 32 aa, Artificial Sequence
  VH Framework 3 (FR3)
RVTISKDNSKSQVSFKMSSLQAQDTAVYYCAR

SEQ ID NO: 1626 - protein, 32 aa, Artificial Sequence
  VH Framework 3 (FR3)
RLTISKDNSKSQVSFKMSSLQAQDTAVYYCAR

SEQ ID NO: 1627 - protein, 32 aa, Artificial Sequence
  VH Framework 3 (FR3)
RVTISRDTSKNQFSLKLSSVTAADTAVYYCAR

SEQ ID NO: 1628 - protein, 32 aa, Artificial Sequence
  VH Framework 3 (FR3)
RLTISRDTSKNQFSLKLSSVTAADTAVYYCAR

SEQ ID NO: 1629 - protein, 32 aa, Artificial Sequence
  VH Framework 3 (FR3)
RVTISRDTSKSQFSLKLSSVTAADTAVYYCAR

SEQ ID NO: 1630 - protein, 32 aa, Artificial Sequence
  VH Framework 3 (FR3)
RVTISRDTSKNQVSLKLSSVTAADTAVYYCAR

SEQ ID NO: 1631 - protein, 32 aa, Artificial Sequence
  VH Framework 3 (FR3)
RVTISRDTSKNQFSFKLSSVTAADTAVYYCAR

SEQ ID NO: 1632 - protein, 32 aa, Artificial Sequence
  VH Framework 3 (FR3)
RLTISRDTSKSQFSLKLSSVTAADTAVYYCAR

SEQ ID NO: 1633 - protein, 32 aa, Artificial Sequence
  VH Framework 3 (FR3)
RLTISRDTSKNQVSLKLSSVTAADTAVYYCAR

SEQ ID NO: 1634 - protein, 32 aa, Artificial Sequence
  VH Framework 3 (FR3)
RLTISRDTSKNQFSFKLSSVTAADTAVYYCAR

SEQ ID NO: 1635 - protein, 32 aa, Artificial Sequence
  VH Framework 3 (FR3)
RVTISRDTSKSQVSLKLSSVTAADTAVYYCAR

SEQ ID NO: 1636 - protein, 32 aa, Artificial Sequence
  VH Framework 3 (FR3)
RVTISRDTSKSQFSFKLSSVTAADTAVYYCAR

SEQ ID NO: 1637 - protein, 32 aa, Artificial Sequence
  VH Framework 3 (FR3)
RVTISRDTSKNQVSFKLSSVTAADTAVYYCAR

SEQ ID NO: 1638 - protein, 32 aa, Artificial Sequence
  VH Framework 3 (FR3)
RLTISRDTSKSQVSLKLSSVTAADTAVYYCAR

SEQ ID NO: 1639 - protein, 32 aa, Artificial Sequence
  VH Framework 3 (FR3)
RLTISRDTSKSQFSFKLSSVTAADTAVYYCAR

SEQ ID NO: 1640 - protein, 32 aa, Artificial Sequence
  VH Framework 3 (FR3)
RLTISRDTSKNQVSFKLSSVTAADTAVYYCAR

SEQ ID NO: 1641 - protein, 32 aa, Artificial Sequence
  VH Framework 3 (FR3)
RVTISRDTSKSQVSFKLSSVTAADTAVYYCAR

SEQ ID NO: 1642 - protein, 32 aa, Artificial Sequence
  VH Framework 3 (FR3)
RLTISRDTSKSQVSFKLSSVTAADTAVYYCAR

SEQ ID NO: 1643 - protein, 32 aa, Artificial Sequence
  VH Framework 3 (FR3) (e.g. clones humanized 3P10, 5F12, 25M22, 17J16)
RVTITADESTSTAYMELSSLRSEDTAVYYCAR

SEQ ID NO: 1644 - protein, 32 aa, Artificial Sequence
  VH Framework 3 (FR3)
RFTITADESTSTAYMELSSLRSEDTAVYYCAR

SEQ ID NO: 1645 - protein, 32 aa, Artificial Sequence
  VH Framework 3 (FR3)
RVTFTADESTSTAYMELSSLRSEDTAVYYCAR

SEQ ID NO: 1646 - protein, 32 aa, Artificial Sequence
  VH Framework 3 (FR3)
RVTITLDESTSTAYMELSSLRSEDTAVYYCAR

SEQ ID NO: 1647 - protein, 32 aa, Artificial Sequence
  VH Framework 3 (FR3)
RVTITADESTSTAYMELSNLRSEDTAVYYCAR

SEQ ID NO: 1648 - protein, 32 aa, Artificial Sequence
  VH Framework 3 (FR3)
RVTITADESTSTAYMELSSLRSEDTAVFYCAR

SEQ ID NO: 1649 - protein, 32 aa, Artificial Sequence
  VH Framework 3 (FR3)
RFTFTADESTSTAYMELSSLRSEDTAVYYCAR

SEQ ID NO: 1650 - protein, 32 aa, Artificial Sequence
  VH Framework 3 (FR3)
RFTITLDESTSTAYMELSSLRSEDTAVYYCAR

SEQ ID NO: 1651 - protein, 32 aa, Artificial Sequence
  VH Framework 3 (FR3)
RFTITADESTSTAYMELSNLRSEDTAVYYCAR

SEQ ID NO: 1652 - protein, 32 aa, Artificial Sequence
  VH Framework 3 (FR3)
RFTITADESTSTAYMELSSLRSEDTAVFYCAR

SEQ ID NO: 1653 - protein, 32 aa, Artificial Sequence
  VH Framework 3 (FR3)
RVTFTLDESTSTAYMELSSLRSEDTAVYYCAR

SEQ ID NO: 1654 - protein, 32 aa, Artificial Sequence
  VH Framework 3 (FR3)
RVTFTADESTSTAYMELSNLRSEDTAVYYCAR

SEQ ID NO: 1655 - protein, 32 aa, Artificial Sequence
  VH Framework 3 (FR3)
RVTFTADESTSTAYMELSSLRSEDTAVFYCAR

SEQ ID NO: 1656 - protein, 32 aa, Artificial Sequence
  VH Framework 3 (FR3)
RVTITLDESTSTAYMELSNLRSEDTAVYYCAR

SEQ ID NO: 1657 - protein, 32 aa, Artificial Sequence
  VH Framework 3 (FR3)
RVTITLDESTSTAYMELSSLRSEDTAVFYCAR

SEQ ID NO: 1658 - protein, 32 aa, Artificial Sequence
  VH Framework 3 (FR3)
RVTITADESTSTAYMELSNLRSEDTAVFYCAR

SEQ ID NO: 1659 - protein, 32 aa, Artificial Sequence
  VH Framework 3 (FR3)
RFTFTLDESTSTAYMELSSLRSEDTAVYYCAR

SEQ ID NO: 1660 - protein, 32 aa, Artificial Sequence
  VH Framework 3 (FR3)
RFTFTADESTSTAYMELSNLRSEDTAVYYCAR

SEQ ID NO: 1661 - protein, 32 aa, Artificial Sequence
  VH Framework 3 (FR3)
RFTFTADESTSTAYMELSSLRSEDTAVFYCAR

SEQ ID NO: 1662 - protein, 32 aa, Artificial Sequence
  VH Framework 3 (FR3)
RVTFTLDESTSTAYMELSNLRSEDTAVYYCAR

SEQ ID NO: 1663 - protein, 32 aa, Artificial Sequence
  VH Framework 3 (FR3)
RVTFTLDESTSTAYMELSSLRSEDTAVFYCAR

SEQ ID NO: 1664 - protein, 32 aa, Artificial Sequence
  VH Framework 3 (FR3)
RVTFTADESTSTAYMELSNLRSEDTAVFYCAR

SEQ ID NO: 1665 - protein, 32 aa, Artificial Sequence
  VH Framework 3 (FR3)
RVTITLDESTSTAYMELSNLRSEDTAVFYCAR

SEQ ID NO: 1666 - protein, 32 aa, Artificial Sequence
  VH Framework 3 (FR3)
RFTFTLDESTSTAYMELSNLRSEDTAVYYCAR

SEQ ID NO: 1667 - protein, 32 aa, Artificial Sequence
  VH Framework 3 (FR3)
RFTFTLDESTSTAYMELSSLRSEDTAVFYCAR

SEQ ID NO: 1668 - protein, 32 aa, Artificial Sequence
  VH Framework 3 (FR3)
RFTFTADESTSTAYMELSNLRSEDTAVFYCAR

SEQ ID NO: 1669 - protein, 32 aa, Artificial Sequence
  VH Framework 3 (FR3)
RVTFTLDESTSTAYMELSNLRSEDTAVFYCAR

SEQ ID NO: 1670 - protein, 32 aa, Artificial Sequence
  VH Framework 3 (FR3)
RFTFTLDESTSTAYMELSNLRSEDTAVFYCAR

SEQ ID NO: 1671 - protein, 32 aa, Artificial Sequence
  VH Framework 3 (FR3)
RVTLTADTSTDTAYMELSSLRSEDTAVYFCAR

SEQ ID NO: 1672 - protein, 32 aa, Artificial Sequence
  VH Framework 3 (FR3)
RFTLTADTSTDTAYMELSSLRSEDTAVYFCAR

SEQ ID NO: 1673 - protein, 32 aa, Artificial Sequence
  VH Framework 3 (FR3)
RVTFTADTSTDTAYMELSSLRSEDTAVYFCAR

SEQ ID NO: 1674 - protein, 32 aa, Artificial Sequence
  VH Framework 3 (FR3)
RVTLTADTSTDTAYLELSSLRSEDTAVYFCAR

SEQ ID NO: 1675 - protein, 32 aa, Artificial Sequence
  VH Framework 3 (FR3)
RFTFTADTSTDTAYMELSSLRSEDTAVYFCAR

SEQ ID NO: 1676 - protein, 32 aa, Artificial Sequence
  VH Framework 3 (FR3)
RFTLTADTSTDTAYLELSSLRSEDTAVYFCAR

SEQ ID NO: 1677 - protein, 32 aa, Artificial Sequence
  VH Framework 3 (FR3)
RVTFTADTSTDTAYLELSSLRSEDTAVYFCAR

SEQ ID NO: 1678 - protein, 32 aa, Artificial Sequence
  VH Framework 3 (FR3)
RFTFTADTSTDTAYLELSSLRSEDTAVYFCAR

SEQ ID NO: 1679 - protein, 32 aa, Artificial Sequence
  VH Framework 3 (FR3) (e.g. clones humanized 5F12, 25M22, 17J16)
RATITADESTSTAYMELSSLRSEDTAVYYCAR

SEQ ID NO: 1680 - protein, 32 aa, Artificial Sequence
  VH Framework 3 (FR3) (e.g. clones humanized 5F12, 25M22, 17J16)
RVTLTADESTSTAYMELSSLRSEDTAVYYCAR

SEQ ID NO: 1681 - protein, 32 aa, Artificial Sequence
  VH Framework 3 (FR3) (e.g. clones humanized 5F12, 25M22)
RVTITADKSTSTAYMELSSLRSEDTAVYYCAR

SEQ ID NO: 1682 - protein, 32 aa, Artificial Sequence
  VH Framework 3 (FR3) (e.g. clones humanized 5F12, 25M22, 17J16)
RATLTADESTSTAYMELSSLRSEDTAVYYCAR

SEQ ID NO: 1683 - protein, 32 aa, Artificial Sequence
  VH Framework 3 (FR3) (e.g. clones humanized 5F12, 25M22)
RATITADKSTSTAYMELSSLRSEDTAVYYCAR

SEQ ID NO: 1684 - protein, 32 aa, Artificial Sequence
  VH Framework 3 (FR3) (e.g. clones humanized 5F12, 25M22)
RVTLTADKSTSTAYMELSSLRSEDTAVYYCAR

SEQ ID NO: 1685 - protein, 32 aa, Artificial Sequence
  VH Framework 3 (FR3) (e.g. clones humanized 5F12, 25M22)
RATLTADKSTSTAYMELSSLRSEDTAVYYCAR

SEQ ID NO: 1686 - protein, 32 aa, Artificial Sequence; identical to SEQ ID NO: 1679
  VH Framework 3 (FR3) (e.g. clone humanized 17J16)

SEQ ID NO: 1687 - protein, 32 aa, Artificial Sequence
  VH Framework 3 (FR3) (e.g. clone humanized 17J16)
RVTITADESSSTAYMELSSLRSEDTAVYYCAR

SEQ ID NO: 1688 - protein, 32 aa, Artificial Sequence
  VH Framework 3 (FR3) (e.g. clone humanized 17J16)
RVTITADESTSTAYLELSSLRSEDTAVYYCAR

SEQ ID NO: 1689 - protein, 32 aa, Artificial Sequence
  VH Framework 3 (FR3) (e.g. clone humanized 17J16)
RVTITADESTSTAYMELSRLRSEDTAVYYCAR

SEQ ID NO: 1690 - protein, 32 aa, Artificial Sequence
  VH Framework 3 (FR3) (e.g. clone humanized 17J16)
RATITADESSSTAYMELSSLRSEDTAVYYCAR

SEQ ID NO: 1691 - protein, 32 aa, Artificial Sequence
  VH Framework 3 (FR3) (e.g. clone humanized 17J16)
RATITADESTSTAYLELSSLRSEDTAVYYCAR

SEQ ID NO: 1692 - protein, 32 aa, Artificial Sequence
  VH Framework 3 (FR3) (e.g. clone humanized 17J16)
RATITADESTSTAYMELSRLRSEDTAVYYCAR

SEQ ID NO: 1693 - protein, 32 aa, Artificial Sequence
  VH Framework 3 (FR3) (e.g. clone humanized 17J16)
RVTLTADESSSTAYMELSSLRSEDTAVYYCAR

SEQ ID NO: 1694 - protein, 32 aa, Artificial Sequence
  VH Framework 3 (FR3) (e.g. clone humanized 17J16)
RVTLTADESTSTAYLELSSLRSEDTAVYYCAR

SEQ ID NO: 1695 - protein, 32 aa, Artificial Sequence
  VH Framework 3 (FR3) (e.g. clone humanized 17J16)
RVTLTADESTSTAYMELSRLRSEDTAVYYCAR

SEQ ID NO: 1696 - protein, 32 aa, Artificial Sequence
  VH Framework 3 (FR3) (e.g. clone humanized 17J16)
RVTITADESSSTAYLELSSLRSEDTAVYYCAR

SEQ ID NO: 1697 - protein, 32 aa, Artificial Sequence
  VH Framework 3 (FR3) (e.g. clone humanized 17J16)
RVTITADESSSTAYMELSRLRSEDTAVYYCAR

SEQ ID NO: 1698 - protein, 32 aa, Artificial Sequence
  VH Framework 3 (FR3) (e.g. clone humanized 17J16)
RVTITADESTSTAYLELSRLRSEDTAVYYCAR

SEQ ID NO: 1699 - protein, 32 aa, Artificial Sequence
  VH Framework 3 (FR3) (e.g. clone humanized 17J16)
RATLTADESSSTAYMELSSLRSEDTAVYYCAR

SEQ ID NO: 1700 - protein, 32 aa, Artificial Sequence
  VH Framework 3 (FR3) (e.g. clone humanized 17J16)
RATLTADESTSTAYLELSSLRSEDTAVYYCAR

SEQ ID NO: 1701 - protein, 32 aa, Artificial Sequence
  VH Framework 3 (FR3) (e.g. clone humanized 17J16)
RATLTADESTSTAYMELSRLRSEDTAVYYCAR

SEQ ID NO: 1702 - protein, 32 aa, Artificial Sequence
  VH Framework 3 (FR3) (e.g. clone humanized 17J16)
RATITADESSSTAYLELSSLRSEDTAVYYCAR

SEQ ID NO: 1703 - protein, 32 aa, Artificial Sequence
  VH Framework 3 (FR3) (e.g. clone humanized 17J16)
RATITADESSSTAYMELSRLRSEDTAVYYCAR

SEQ ID NO: 1704 - protein, 32 aa, Artificial Sequence
  VH Framework 3 (FR3) (e.g. clone humanized 17J16)
RATITADESTSTAYLELSRLRSEDTAVYYCAR

SEQ ID NO: 1705 - protein, 32 aa, Artificial Sequence
  VH Framework 3 (FR3) (e.g. clone humanized 17J16)
RVTLTADESSSTAYLELSSLRSEDTAVYYCAR

SEQ ID NO: 1706 - protein, 32 aa, Artificial Sequence
  VH Framework 3 (FR3) (e.g. clone humanized 17J16)
RVTLTADESSSTAYMELSRLRSEDTAVYYCAR

SEQ ID NO: 1707 - protein, 32 aa, Artificial Sequence
  VH Framework 3 (FR3) (e.g. clone humanized 17J16)
RVTLTADESTSTAYLELSRLRSEDTAVYYCAR

SEQ ID NO: 1708 - protein, 32 aa, Artificial Sequence
  VH Framework 3 (FR3) (e.g. clone humanized 17J16)
RVTITADESSSTAYLELSRLRSEDTAVYYCAR

SEQ ID NO: 1709 - protein, 32 aa, Artificial Sequence
  VH Framework 3 (FR3) (e.g. clone humanized 17J16)
RATLTADESSSTAYLELSSLRSEDTAVYYCAR

SEQ ID NO: 1710 - protein, 32 aa, Artificial Sequence
  VH Framework 3 (FR3) (e.g. clone humanized 17J16)
RATLTADESSSTAYMELSRLRSEDTAVYYCAR

SEQ ID NO: 1711 - protein, 32 aa, Artificial Sequence
  VH Framework 3 (FR3) (e.g. clone humanized 17J16)
RATLTADESTSTAYLELSRLRSEDTAVYYCAR

SEQ ID NO: 1712 - protein, 32 aa, Artificial Sequence
  VH Framework 3 (FR3) (e.g. clone humanized 17J16)
RATITADESSSTAYLELSRLRSEDTAVYYCAR

SEQ ID NO: 1713 - protein, 32 aa, Artificial Sequence
  VH Framework 3 (FR3) (e.g. clone humanized 17J16)
RVTLTADESSSTAYLELSRLRSEDTAVYYCAR

SEQ ID NO: 1714 - protein, 32 aa, Artificial Sequence
  VH Framework 3 (FR3) (e.g. clone humanized 17J16)
RATLTADESSSTAYLELSRLRSEDTAVYYCAR

SEQ ID NO: 1715 - protein, 32 aa, Artificial Sequence
  VH Framework 3 (FR3)
RVTITRDTSASTAYMELSSLRSEDTAVYYCAR

SEQ ID NO: 1716 - protein, 32 aa, Artificial Sequence
  VH Framework 3 (FR3)
RATITRDESASTAYMELSSLRSEDTAVYYCAR

SEQ ID NO: 1717 - protein, 32 aa, Artificial Sequence
  VH Framework 3 (FR3)
RVTLTRDESASTAYMELSSLRSEDTAVYYCAR

SEQ ID NO: 1718 - protein, 32 aa, Artificial Sequence
  VH Framework 3 (FR3)
RVTITRDKSASTAYMELSSLRSEDTAVYYCAR

SEQ ID NO: 1719 - protein, 32 aa, Artificial Sequence
  VH Framework 3 (FR3)
RATLTRDESASTAYMELSSLRSEDTAVYYCAR

SEQ ID NO: 1720 - protein, 32 aa, Artificial Sequence
  VH Framework 3 (FR3)
RATITRDKSASTAYMELSSLRSEDTAVYYCAR

SEQ ID NO: 1721 - protein, 32 aa, Artificial Sequence
  VH Framework 3 (FR3)
RVTLTRDKSASTAYMELSSLRSEDTAVYYCAR

SEQ ID NO: 1722 - protein, 32 aa, Artificial Sequence
  VH Framework 3 (FR3)
RATLTRDKSASTAYMELSSLRSEDTAVYYCAR

SEQ ID NO: 1723 - protein, 32 aa, Artificial Sequence
  VH Framework 3 (FR3)
QVTISADKSISTAYLQWSSLKASDTAMYYCAR

SEQ ID NO: 1724 - protein, 32 aa, Artificial Sequence
  VH Framework 3 (FR3)
QATISADKSISTAYLQWSSLKASDTAMYYCAR

SEQ ID NO: 1725 - protein, 32 aa, Artificial Sequence
  VH Framework 3 (FR3)
QVTLSADKSISTAYLQWSSLKASDTAMYYCAR

SEQ ID NO: 1726 - protein, 32 aa, Artificial Sequence
  VH Framework 3 (FR3)
QATLSADKSISTAYLQWSSLKASDTAMYYCAR

SEQ ID NO: 1727 - protein, 11 aa, Artificial Sequence
  VH Framework 4 (FR4)
WGQGTLVTVSS

SEQ ID NO: 1728 - protein, 11 aa, Artificial Sequence
  VH Framework 4 (FR4)
WGQGTTVTVSS

SEQ ID NO: 1729 - protein, 23 aa, Artificial Sequence
  VL Framework 1 (FR1)
DVVMTQSPLSLPVTLGQPASISC

SEQ ID NO: 1730 - protein, 23 aa, Artificial Sequence
  VL Framework 1 (FR1)
DVVLTQSPLSLPVTLGQPASISC

SEQ ID NO: 1731 - protein, 23 aa, Artificial Sequence
  VL Framework 1 (FR1)
DVVLTQSPLSLPVTLGDPASISC

SEQ ID NO: 1732 - protein, 23 aa, Artificial Sequence
  VL Framework 1 (FR1)
DVVLTQSPLSLPVTLGDPASISC

SEQ ID NO: 1733 - protein, 23 aa, Artificial Sequence
  VL Framework 1 (FR1)
DIVMTQSPLSLPVTLGQPASISC

SEQ ID NO: 1734 - protein, 23 aa, Artificial Sequence
  VL Framework 1 (FR1)
DIVLTQSPLSLPVTLGQPASISC

SEQ ID NO: 1735 - protein, 23 aa, Artificial Sequence
  VL Framework 1 (FR1)
DVAMTQSPLSLPVTLGQPASISC

SEQ ID NO: 1736 - protein, 23 aa, Artificial Sequence
  VL Framework 1 (FR1)
DVALTQSPLSLPVTLGQPASISC

SEQ ID NO: 1737 - protein, 23 aa, Artificial Sequence
  VL Framework 1 (FR1)
DVVLTQTPLSLPVSPGDQASISC

SEQ ID NO: 1738 - protein, 23 aa, Artificial Sequence
  VL Framework 1 (FR1)
DIVMTQTPLSLPVSPGDQASISC

SEQ ID NO: 1739 - protein, 23 aa, Artificial Sequence
  VL Framework 1 (FR1)
DIVMTQTPLSLPVSPGDQASISC

SEQ ID NO: 1740 - protein, 23 aa, Artificial Sequence
  VL Framework 1 (FR1)
DIVMTQTPLSLPVSPGDQASISC

SEQ ID NO: 1741 - protein, 23 aa, Artificial Sequence
  VL Framework 1 (FR1)
DIELTQSPASLAVSLGQRATISC

SEQ ID NO: 1742 - protein, 23 aa, Artificial Sequence
  VL Framework 1 (FR1)
DIVLTQSPASLAVSLGQRATISC

SEQ ID NO: 1743 - protein, 23 aa, Artificial Sequence
  VL Framework 1 (FR1)
DIVMTQSPDSLAVSLGERATINC

SEQ ID NO: 1744 - protein, 23 aa, Artificial Sequence
  VL Framework 1 (FR1)
DIVLTQSPDSLAVSLGERATINC

SEQ ID NO: 1745 - protein, 23 aa, Artificial Sequence
  VL Framework 1 (FR1)
DIQMTQSPSSLSASVGDRVTITC

SEQ ID NO: 1746 - protein, 23 aa, Artificial Sequence
  VL Framework 1 (FR1)
DIQLTQSPSSLSASVGDRVTITC

SEQ ID NO: 1747 - protein, 23 aa, Artificial Sequence
  VL Framework 1 (FR1)
EIVLTQSPATLSLSPGERATLSC

SEQ ID NO: 1748 - protein, 23 aa, Artificial Sequence
  VL Framework 1 (FR1)
EIVLTQSPATLSVSPGERATLSC

SEQ ID NO: 1749 - protein, 23 aa, Artificial Sequence
  VL Framework 1 (FR1)
EIVLTQSPGTLSLSPGERATLSC

SEQ ID NO: 1750 - protein, 23 aa, Artificial Sequence
  VL Framework 1 (FR1)
EVVLTQSPGTLSLSPGERATLSC

SEQ ID NO: 1751 - protein, 15 aa, Artificial Sequence
  VL Framework 2 (FR2)
WFQQRPGQSPRRLIY

SEQ ID NO: 1752 - protein, 15 aa, Artificial Sequence
  VL Framework 2 (FR2)
WYQQRPGQSPRRLIY

SEQ ID NO: 1753 - protein, 15 aa, Artificial Sequence
  VL Framework 2 (FR2)
WFQQKPGQSPRRLIY

SEQ ID NO: 1754 - protein, 15 aa, Artificial Sequence
  VL Framework 2 (FR2)
WFQQRPGQSPKRLIY

SEQ ID NO: 1755 - protein, 15 aa, Artificial Sequence
  VL Framework 2 (FR2)
WFQQRPGQSPRLLIY

SEQ ID NO: 1756 - protein, 15 aa, Artificial Sequence
  VL Framework 2 (FR2)
WYQQKPGQSPRRLIY

SEQ ID NO: 1757 - protein, 15 aa, Artificial Sequence
  VL Framework 2 (FR2)
WYQQRPGQSPKRLIY

SEQ ID NO: 1758 - protein, 15 aa, Artificial Sequence
  VL Framework 2 (FR2)
WYQQRPGQSPRLLIY

SEQ ID NO: 1759 - protein, 15 aa, Artificial Sequence
  VL Framework 2 (FR2)
WFQQKPGQSPKRLIY

SEQ ID NO: 1760 - protein, 15 aa, Artificial Sequence
  VL Framework 2 (FR2)
WFQQKPGQSPRLLIY

SEQ ID NO: 1761 - protein, 15 aa, Artificial Sequence
  VL Framework 2 (FR2)
WFQQRPGQSPKLLIY

SEQ ID NO: 1762 - protein, 15 aa, Artificial Sequence
  VL Framework 2 (FR2)
WYQQKPGQSPKRLIY

SEQ ID NO: 1763 - protein, 15 aa, Artificial Sequence
  VL Framework 2 (FR2)
WYQQKPGQSPRLLIY

SEQ ID NO: 1764 - protein, 15 aa, Artificial Sequence
  VL Framework 2 (FR2)
WYQQRPGQSPKLLIY

SEQ ID NO: 1765 - protein, 15 aa, Artificial Sequence
  VL Framework 2 (FR2)
WFQQKPGQSPKLLIY

SEQ ID NO: 1766 - protein, 15 aa, Artificial Sequence
  VL Framework 2 (FR2)
WYQQKPGQSPKLLIY

SEQ ID NO: 1767 - protein, 15 aa, Artificial Sequence
  VL Framework 2 (FR2)
WLQQRPGQSPRRLIY

SEQ ID NO: 1768 - protein, 15 aa, Artificial Sequence
  VL Framework 2 (FR2)
WLQQRPGQSPKRLIY

SEQ ID NO: 1769 - protein, 15 aa, Artificial Sequence
  VL Framework 2 (FR2)
WFQQRPGQSPRRLIF

SEQ ID NO: 1770 - protein, 15 aa, Artificial Sequence
  VL Framework 2 (FR2)
WYQQRPGQSPRRLIF

SEQ ID NO: 1771 - protein, 15 aa, Artificial Sequence
  VL Framework 2 (FR2)
WFQQRPGQSPRLLIF

SEQ ID NO: 1772 - protein, 15 aa, Artificial Sequence
  VL Framework 2 (FR2)
WYQQRPGQSPRLLIF

SEQ ID NO: 1773 - protein, 15 aa, Artificial Sequence
  VL Framework 2 (FR2)
WYLQKPGQSPKLLIY

SEQ ID NO: 1774 - protein, 15 aa, Artificial Sequence
  VL Framework 2 (FR2)
WYQQKPGQPPKLLIY

SEQ ID NO: 1775 - protein, 15 aa, Artificial Sequence
  VL Framework 2 (FR2)
WYQQKPGKAPKLLIY

SEQ ID NO: 1776 - protein, 15 aa, Artificial Sequence
  VL Framework 2 (FR2)
WYQQKPGQAPRLLIY

SEQ ID NO: 1777 - protein, 15 aa, Artificial Sequence
  VL Framework 2 (FR2)
WYQQKPGQAPRLLIF

SEQ ID NO: 1778 - protein, 32 aa, Artificial Sequence
  VL Framework 3 (FR3)
GVPDRFSGSGSGTDFTLKISRVEAEDVGVYYC

SEQ ID NO: 1779 - protein, 32 aa, Artificial Sequence
  VL Framework 3 (FR3)
GVPDRFSGSGSGADFTLKISRVEAEDVGVYYC

SEQ ID NO: 1780 - protein, 32 aa, Artificial Sequence
  VL Framework 3 (FR3)
GVPDRFSGSGSGTDFTLKISRVEAEDVGVYFC

SEQ ID NO: 1781 - protein, 32 aa, Artificial Sequence
  VL Framework 3 (FR3)
GVPDRFSGSGSRTDFTLKISRVEAEDVGVYYC

SEQ ID NO: 1782 - protein, 32 aa, Artificial Sequence
  VL Framework 3 (FR3)
GVPDRFSGSGSGTDFTLTISSLQAEDVAVYYC

SEQ ID NO: 1783 - protein, 32 aa, Artificial Sequence
  VL Framework 3 (FR3)
GVPDRFSGSGSRTDFTLTISSLQAEDVAVYYC

SEQ ID NO: 1784 - protein, 32 aa, Artificial Sequence
  VL Framework 3 (FR3)
GVPDRFSGSGSGTDFTLTISSVQAEDVAVYYC

SEQ ID NO: 1785 - protein, 32 aa, Artificial Sequence
  VL Framework 3 (FR3)
GVPDRFSGSGSRTDFTLTISSVQAEDVAVYYC

SEQ ID NO: 1786 - protein, 32 aa, Artificial Sequence
  VL Framework 3 (FR3)
GVPSRFSGSGSGTDFTLTISSLQPEDFATYYC

SEQ ID NO: 1787 - protein, 32 aa, Artificial Sequence
  VL Framework 3 (FR3)
GVPSRFSGSGSGTDFTLTISSVQPEDFATYYC

SEQ ID NO: 1788 - protein, 32 aa, Artificial Sequence
  VL Framework 3 (FR3)
GIPARFSGSGSGTDFTLTISSLEPEDFAVYYC

SEQ ID NO: 1789 - protein, 32 aa, Artificial Sequence
  VL Framework 3 (FR3)
GVPARFSGSGSGTDFTLTISSLEPEDFAVYYC

SEQ ID NO: 1790 - protein, 32 aa, Artificial Sequence
  VL Framework 3 (FR3)
GIPARFSGSGSGTDFTLTISSVEPEDFAVYYC

SEQ ID NO: 1791 - protein, 32 aa, Artificial Sequence
  VL Framework 3 (FR3)
GVPARFSGSGSGTDFTLTISSVEPEDFAVYYC

SEQ ID NO: 1792 - protein, 32 aa, Artificial Sequence
  VL Framework 3 (FR3)
GIPDRFSGSGSGTDFTLTISRLEPEDFAVYYC

SEQ ID NO: 1793 - protein, 10 aa, Artificial Sequence
  VL Framework 4 (FR4)
FGGGTKVEIK

SEQ ID NO: 1794 - protein, 10 aa, Artificial Sequence
  VL Framework 4 (FR4)
FGSGTKLEIK

SEQ ID NO: 1795 - protein, 8 aa, Artificial Sequence
  CDR Sequence
GFTFTDYY

SEQ ID NO: 1796 - protein, 7 aa, Artificial Sequence
  CDR Sequence
GFTFTDY

SEQ ID NO: 1797 - protein, 394 aa, Homo sapiens
  full-length precursor human GFRAL with signal peptide sequence
MIVFIFLAMGLSLENEYTSQTNNCTYLREQCLRDANGCKHAWRVMEDACNDSDPGDPCKMRNSSYCNLSIQYLVESNFQFKECLCTDDFYCTVNKLLGKKCINKSDNVKEDKFKWNLTTRSHHGFKGMWSCLEVAEACVGDVVCNAQLASYLKACSANGNPCDLKQCQAAIRFFYQNIPFNIAQMLAFCDCAQSDIPCQQSKEALHSKTCAVNMVPPPTCLSVIRSCQNDELCRRHYRTFQSKCWQRVTRKCHEDENCISTLSKQDLTCSGSDDCKAAYIDILGTVLQVQCTCRTITQSEESLCKIFQHMLHRKSCFNYPTLSNVKGMALYTRKHANKITLTGFHSPFNGEVIYAAMCMTVTCGILLLVMVKLRTSRISSKARDPSSIQIPGEL

SEQ ID NO: 1798 - protein, 375 aa, Homo sapiens
  mature human GFRAL polypeptide
QTNNCTYLREQCLRDANGCKHAWRVMEDACNDSDPGDPCKMRNSSYCNLSIQYLVESNFQFKECLCTDDFYCTVNKLLGKKCINKSDNVKEDKFKWNLTTRSHHGFKGMWSCLEVAEACVGDVVCNAQLASYLKACSANGNPCDLKQCQAAIRFFYQNIPFNIAQMLAFCDCAQSDIPCQQSKEALHSKTCAVNMVPPPTCLSVIRSCQNDELCRRHYRTFQSKCWQRVTRKCHEDENCISTLSKQDLTCSGSDDCKAAYIDILGTVLQVQCTCRTITQSEESLCKIFQHMLHRKSCFNYPTLSNVKGMALYTRKHANKITLTGFHSPFNGEVIYAAMCMTVTCGILLLVMVKLRTSRISSKARDPSSIQIPGEL

SEQ ID NO: 1799 - DNA, 1911 bp, Artificial Sequence
  nucleic acid sequence encoding a precursor GFRAL polypeptide
ttattctggacagttactcttaagaaagttgtcagaagaaacgcatctgcctttttttccaggtgaactgccgtgagttgtccagcatgatagtgtttattttcttggctatggggttaagcttggaaaatgaatacacttcccaaaccaataattgcacatatttaagagagcaatgcttacgtgatgcaaatggatgtaaacatgcttggagagtaatggaagatgcctgcaatgattcagatccaggtgacccctgcaagatgaggaattcatcatactgtaacctgagtatccagtacttagtggaaagcaatttccaatttaaagagtgtctttgcactgatgacttctattgtactgtgaacaaactgcttggaaaaaaatgtatcaataaatcagataacgtgaaagaggataaattcaaatggaatctaactacacgttcccatcatggattcaaagggatgtggtcctgtttggaagtggcagaggcatgtgtaggggatgtggtctgtaatgcacagttggcctcttaccttaaagcttgctcagcaaatggaaatccgtgtgatctgaaacagtgccaagcagccatacggttcttctatcaaaatataccttttaacattgcccagatgttggctttttgtgactgtgctcaatctgatataccttgtcagcagtccaaagaagctcttcacagcaagacatgtgcagtgaacatggttccaccccctacttgcctcagtgtaattcgcagctgccaaaatgatgaattatgcaggaggcactatagaacatttcagtcaaaatgctggcagcgtgtgactagaaagtgccatgaagatgagaattgcattagcaccttaagcaaacaggacctcacttgttcaggaagtgatgactgcaaagctgcttacatagatatccttgggacggtccttcaagtgcaatgtacctgtaggaccattacacaaagtgaggaatctttgtgtaagattttccagcacatgcttcatagaaaatcatgtttcaattatccaaccctgtctaatgtcaaaggcatggcattgtatacaagaaaacatgcaaacaaaatcactttaactggatttcattcccccttcaatggagaagtaatctatgctgccatgtgcatgacagtcacctgtggaatccttctgttggttatggtcaagcttagaacttccagaatatcaagtaaagcaagagatccttcatcgatccaaatacctggagaactctgattcattaggagtcatggacctataacaatcactcttttctctgcttttcttctttcctcttttcttctctcctctcctctcctctcttctcctctcctcccctcccctctctgtttctttttctttttcttttcttttttgtggcggagttttgctcttgttgcccaggctgcagtacaatggctcaatctcggttcactgcaacctctgcctccaaggttcaagtgattttcctgcctcagccttcccgagtagctgggattacaggtacccgccaccacgcccagctaatttttttgtatttttagtagagatggggttttgccaaattggccagggtggtctcaaactcctgacctcaggtgatccacccacctcggcctcccaaagtgctgggattacaggcgtgagcaaccacgtcaagacaacaatcactttctttaaagcaaatcctacagctggtcaacaccctattccatctgtcatcgagaaagaaaatgttaaaatagacttaaaaatattgctttgttacatataataatatggcatgatgatgttatttttttcttaatactcaagaaaaaatatatggtggtatcttttacaacactggaacagaaataaagtttcccttgaaggc

SEQ ID NO: 1800 - protein, 394 aa, Macaca fascicularis
  GFRAL protein - Cynomolgus Monkey
MIVLIFLALGLSLENEYTSQTNNCTYLREQCLHDANGCKHAWRIMEDACNDSDPGDPCKMNNSSYCNLSIQYLVESNFRFKECLCTDDFYCTVNKLLGKECVNKSDNMREDKFKWNLTTHSHHGFKGMWSCLEVAEACVGDVVCNAQLASYLKACSANGNPCDVKHCQAAIRFFYQNIPFNIAQMLAFCDCSQSDIPCQQSKEALHSKPCALNMVPPPTCLNVIRSCQNDELCRRHYRTFQSKCWQRVTRKCHEDENCISALSKQDLTCSGSDDCKAAYIDILGTVLQVQCNCRTITQSEESLCKIFQHMLHRKSCFNYPTLSNVKSMALYTRKHTNKITLTGFQSPFNGEVIYAAMCMTVTCGILLLVMVKLRTSRISSKARDPSLSQVPGEL

SEQ ID NO: 1801 - DNA, 1476 bp, Macaca fascicularis
  encoding nucleic acid sequence of a cyno GFRAL protein
acccaccagaaagaaggagctccagacacatctgaacgtctgaaggaagaaactcccgacacaccatctttaagaaatgtaactctcactgcgagggtatgtggcttcattcttgaagtcagggagaccaagaacccaccaattgcaggcacacaaggggtccttattttattcaggtgaacagctgtgagttgtccagcatgatagtgcttattttcttggctttggggctaagcttggaaaatgaatacacttcccaaaccaataattgcacatatttaagagagcaatgcctacatgatgcaaatggatgtaaacatgcttggagaataatggaagatgcctgcaatgattcagatccaggtgacccctgcaagatgaataattcatcatactgtaacctgagtatccagtacttagtggaaagcaatttccgatttaaagagtgtctttgcactgatgacttctattgtactgtgaacaaactgcttggaaaagaatgtgtcaataaatcagataacatgagagaggataaattcaaatggaatctaactacacattcccatcatggattcaaagggatgtggtcctgtttggaagtggcagaggcatgtgtaggggatgtggtctgtaatgcacagttggcctcttaccttaaagcttgctcagcaaatggaaatccgtgtgatgtgaaacactgccaagcagccatacggttcttctatcaaaatataccttttaacattgcccagatgttggctttttgtgactgttctcaatctgatataccttgtcagcagtccaaagaagctcttcacagcaagccatgtgcactgaacatggttccaccccctacttgcctcaatgtaattcgcagctgccaaaatgatgaattatgcaggaggcactatagaacatttcagtcaaaatgctggcagcgtgtgactagaaagtgccatgaagatgagaattgcattagcgccttaagcaaacaggacctcacatgttcaggaagtgatgactgcaaagctgcttacatagatatccttgggacagtccttcaagtgcaatgtaactgtaggaccattacacaaagtgaggaatctttgtgcaagattttccagcacatgcttcatagaaaatcatgtttcaattatccaaccctgtctaatgtcaaaagcatggcattgtatacaagaaaacatacaaacaaaatcactttaactggatttcagtcccccttcaatggagaagtaatctatgctgccatgtgcatgacagtcacctgtggaatccttctcttggttatggtcaagcttagaacttccagaatatcaagtaaagcaagagatccttcactgagccaagtacctggagaactctgattcattaggagtcatggacccataacaatcactccccttcccttcccttcccttcccttcccttcccttcccttcccttcccttcccttcc

SEQ ID NO: 1802 - protein, 393 aa, Mus musculus
  GFRAL protein - mouse
MLVFIFLAVTLSSENESSSQTNDCAHLIQKCLIDANGCEQSWRSMEDTCLTPGDSCKINNSLHCNLSIQALVEKNFQFKECLCMDDLHCTVNKLFGKKCTNKTDNMEKDNKDKWNLTTTPFYHGFKQMQSCLEVTEACVGDVVCNAQLALYLKACSANGNLCDVKHCQAAIRFFYQNMPFNTAQMLAFCDCAQSDIPCQQSKETLHSKPCALNIVPPPTCLSVIHTCRNDELCRTHYRTFQTECWPHITGKCHEDETCISMLGKQDLTCSGSESCRAAFLGTFGTVLQVPCACRGVTQAEEHVCMIFQHMLHSKSCFNYPTPNVKDISSYEKKNSKEITLTGFNSFFNGELLYVVVCMAVTCGILFLVMLKLRIQSEKRDPSSIEIAGGVIIQ

SEQ ID NO: 1803 - DNA, 2080 bp, Mus musculus
  encoding nucleic acid sequence of a mouse GFRAL protein
aacaattgaatttgaatacaattaggaaagttcacagctcaaaacaaactggtgaggaacagctgacaccagaagctgactctaattggctggctcttaggaagcaaaacctttacacagaaacttcagttgggatgttggttggtgtcagttcatccgcctttctcccagggagaccatcttgagttgtccaacatgctagtgttcattttcctggctgttacgttaagctcagaaaatgaatcctcttcccaaacaaatgattgtgcacatttaatacagaaatgcttgattgatgcaaatggctgtgagcagtcatggagatcaatggaagacacctgccttactccaggtgactcctgcaagataaataattcactacattgtaacctgagtatccaggctttggtggaaaaaaatttccaatttaaagagtgtctttgtatggatgacctccactgtacagtaaacaaactttttggaaaaaagtgcaccaataagacagataacatggaaaaggacaataaagataaatggaatctaactactactcctttctatcatggattcaaacagatgcagtcttgtttggaggtgacagaggcgtgtgtaggggatgtggtttgtaatgcacagttggccctttaccttaaagcatgctcagcaaatggaaatctgtgtgatgtgaaacactgccaagcagccatacggttcttctatcaaaatatgccttttaacactgcccagatgttggctttttgtgactgtgctcaatctgatataccctgtcagcaatccaaagaaactcttcacagcaagccatgtgcactgaatatagttccaccccccacttgcctcagtgtaattcacacttgccgaaatgatgaattatgcaggacacactaccgaacattccagacagaatgctggccccacataactgggaagtgccatgaagatgagacctgcattagcatgttaggcaagcaagaccttacttgttctgggagtgagagctgcagggctgccttcctaggaacctttgggacagtcctgcaagtaccctgtgcttgcaggggcgttacacaggctgaagaacacgtgtgcatgattttccagcacatgcttcatagcaaatcgtgtttcaattacccaactcctaatgtcaaagacatttcctcatatgaaaaaaagaattcaaaagaaattactctgactggattcaattctttcttcaatggagaactactctatgttgttgtgtgcatggcagttacctgtggaattcttttcttggtgatgctcaagttaaggatacaaagtgaaaaaagagatccctcatccatcgaaatagctggaggtgtcatcattcagtgagctgcagatcacttaccaaccacatgtctgtgtgactaaccaatggaaaattacatttgccaataacgcaatttaagatggatttgacaatatttagtcattatatgtaacagtgactggtacagtaatataccacaatgatcacagatctgtttttgtttttgtttttaatgtttgagtaaatacttgttgtggtgtcataactagttgataacattttctttaaagacaacaggtgtcatgtaaaatgtgacaaatttgctggaagactatcaatccacatatcaacttctatcttatggaactaatcataattagtgtgtgcagttttctgaacaaggttatagttttccattaagttggtaaaattaaaatgctaagtagaatattgagtatacttgttatttatatattcttacttagtgtccaatcattaaacaaattggtaacattgaacatatttagttagatgactgcttatgaaaataagaactgacatcttacaaattttataatttaaatagtattgaattttactttttatttggtatgttaagattcataatatataaagcagctacattggttgagaaaagtcaatggttactccagtaatgatatactttgtgaatttatttatttttgctaattaatgatcctgaatgtaatcatgatgaaataaaaaagacatacttaaattgct

SEQ ID NO: 1804 - protein, 394 aa, Rattus norvegicus
  GFRAL protein - rat
MLVFIFLAVRLSSENESSSQTNDCAYFMRQCLTDTDGCKQSWRSMEDACLVSGDSCKINNPLPCNLSIQSLVEKHFQFKGCLCTDDLHCTVNKIFGKKCTNKTDSMKKDNKYKRNLTTPLYHDTGFKQMQSCLEVTEACVGDVVCNAQLALYLKACTANGNLCDVKHCQAAIRFFYQNMPFNTAQMLAFCDCAQSDIPCQQSKETLHSKPCALNVVPPPTCLSVIHTCRNDELCRTYYRTFQTECWPHVAGKCREDETCISMLGKQDLTCSGSDSCRAAYLGTFGTVLQVPCACRSITQGEEPLCMAFQHMLHSKSCFNYPTPNVKDISSYERKHSKEITLTGFNSPFSGELIYVVVCMVVTSGILSLVMLKLRIPSKKRDPAPIEIAGAVIIQ

SEQ ID NO: 1805 - DNA, 1125 bp, Rattus norvegicus
  encoding nucleic acid sequence of a rat GFRAL protein
acaaatgattgtgcatatttcatgcggcaatgcttgactgatacagatggctgtaagcagtcatggagatcaatggaagacgcctgccttgtctcaggtgactcctgcaagataaataatccattgccttgtaacctgagtatccagtctttggtggaaaaacattttcaatttaaagggtgtctttgcactgatgatctccactgtacagtaaacaaaatttttggaaaaaagtgcaccaataagacagatagcatgaaaaaagataataaatacaaacggaatctaactactcctttatatcatgatacaggattcaaacagatgcagtcttgtttggaagtgacagaggcgtgtgtaggggatgtggtttgtaatgcacagttggccctttaccttaaagcatgcacagcaaatggaaatctgtgtgatgtgaaacactgccaagcggccatacggttcttctatcaaaatatgccttttaacactgcccagatgttggctttttgtgactgtgctcaatctgatataccctgtcaacaatccaaagaaactcttcacagcaagccatgtgcactgaacgtagttccaccccccacttgcctcagtgtaattcacacttgccgaaatgatgaattatgcaggacatactaccgaacattccagacagaatgctggccccatgtggctgggaagtgtcgtgaagatgagacctgcattagtatgctgggcaagcaagaccttacttgttctgggagtgacagctgcagggcagcctacctaggaaccttcgggacagtccttcaggtgccgtgtgcttgcagaagcatcacacagggtgaagaacccttgtgcatggctttccagcacatgcttcacagcaaatcatgtttcaattacccaactcctaatgtcaaagacatttcctcatatgaaagaaagcattcaaaagaaattaccctgactggattcaattctcccttcagtggagaactaatctatgttgttgtgtgcatggtagttaccagcgggattctttccttggtgatgctcaagctaaggatacctagtaagaaaagagaccccgcgcccatcgaaatagctggagctgtcatcattcagtga

SEQ ID NO: 1806 - protein, 332 aa, Homo sapiens
  GFRAL ECD fragment
QTNNCTYLREQCLRDANGCKHAWRVMEDACNDSDPGDPCKMRNSSYCNLSIQYLVESNFQFKECLCTDDFYCTVNKLLGKKCINKSDNVKEDKFKWNLTTRSHHGFKGMWSCLEVAEACVGDVVCNAQLASYLKACSANGNPCDLKQCQAAIRFFYQNIPFNIAQMLAFCDCAQSDIPCQQSKEALHSKTCAVNMVPPPTCLSVIRSCQNDELCRRHYRTFQSKCWQRVTRKCHEDENCISTLSKQDLTCSGSDDCKAAYIDILGTVLQVQCTCRTITQSEESLCKIFQHMLHRKSCFNYPTLSNVKGMALYTRKHANKITLTGFHSPFNGE

SEQ ID NO: 1807 - protein, 351 aa, Artificial Sequence
  GFRAL ECD fragment
MIVFIFLAMGLSLENEYTSQTNNCTYLREQCLRDANGCKHAWRVMEDACNDSDPGDPCKMRNSSYCNLSIQYLVESNFQFKECLCTDDFYCTVNKLLGKKCINKSDNVKEDKFKWNLTTRSHHGFKGMWSCLEVAEACVGDVVCNAQLASYLKACSANGNPCDLKQCQAAIRFFYQNIPFNIAQMLAFCDCAQSDIPCQQSKEALHSKTCAVNMVPPPTCLSVIRSCQNDELCRRHYRTFQSKCWQRVTRKCHEDENCISTLSKQDLTCSGSDDCKAAYIDILGTVLQVQCTCRTITQSEESLCKIFQHMLHRKSCFNYPTLSNVKGMALYTRKHANKITLTGFHSPFNGE

SEQ ID NO: 1808 - protein, 297 aa, Homo sapiens
  GFRAL ECD fragment
QTNNCTYLREQCLRDANGCKHAWRVMEDACNDSDPGDPCKMRNSSYCNLSIQYLVESNFQFKECLCTDDFYCTVNKLLGKKCINKSDNVKEDKFKWNLTTRSHHGFKGMWSCLEVAEACVGDVVCNAQLASYLKACSANGNPCDLKQCQAAIRFFYQNIPFNIAQMLAFCDCAQSDIPCQQSKEALHSKTCAVNMVPPPTCLSVIRSCQNDELCRRHYRTFQSKCWQRVTRKCHEDENCISTLSKQDLTCSGSDDCKAAYIDILGTVLQVQCTCRTITQSEESLCKIFQHMLHRKSC

SEQ ID NO: 1809 - protein, 237 aa, Homo sapiens
  GFRAL ECD fragment
WNLTTRSHHGFKGMWSCLEVAEACVGDVVCNAQLASYLKACSANGNPCDLKQCQAAIRFFYQNIPFNIAQMLAFCDCAQSDIPCQQSKEALHSKTCAVNMVPPPTCLSVIRSCQNDELCRRHYRTFQSKCWQRVTRKCHEDENCISTLSKQDLTCSGSDDCKAAYIDILGTVLQVQCTCRTITQSEESLCKIFQHMLHRKSCFNYPTLSNVKGMALYTRKHANKITLTGFHSPFNGE

SEQ ID NO: 1810 - protein, 308 aa, Homo sapiens
  precursor human GDF15 polypeptide
MPGQELRTVNGSQMLLVLLVLSWLPHGGALSLAEASRASFPGPSELHSEDSRFRELRKRYEDLLTRLRANQSWEDSNTDLVPAPAVRILTPEVRLGSGGHLHLRISRAALPEGLPEASRLHRALFRLSPTASRSWDVTRPLRRQLSLARPQAPALHLRLSPPPSQSDQLLAESSSARPQLELHLRPQAARGRRRARARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 1811 - protein, 112 aa, Homo sapiens
  mature human GDF15 polypeptide
ARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 1812 - protein, 1049 aa, Homo sapiens
  mature human RET9
KVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGRISHAFTRF

SEQ ID NO: 1813 - protein, 1072 aa, Homo sapiens
  full-length precursor human RET protein
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGRISHAFTRF

SEQ ID NO: 1814 - protein, 612 aa, Artificial Sequence
  RET-ECD
KVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCR

SEQ ID NO: 1815 - protein, 607 aa, Artificial Sequence
  RET-ECD
LYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCR

SEQ ID NO: 1816 - protein, 607 aa, Artificial Sequence; identical to SEQ ID NO: 1815
  RET-ECD fragment

SEQ ID NO: 1817 - protein, 419 aa, Artificial Sequence
  Construct 1 (IgK-2Flag-GFRAL)
MDMRVPAQLLGLLLLWLRGARCDYKDDDDKSAGGDYKDDDDKGGQTNNCTYLREQCLRDANGCKHAWRVMEDACNDSDPGDPCKMRNSSYCNLSIQYLVESNFQFKECLCTDDFYCTVNKLLGKKCINKSDNVKEDKFKWNLTTRSHHGFKGMWSCLEVAEACVGDVVCNAQLASYLKACSANGNPCDLKQCQAAIRFFYQNIPFNIAQMLAFCDCAQSDIPCQQSKEALHSKTCAVNMVPPPTCLSVIRSCQNDELCRRHYRTFQSKCWQRVTRKCHEDENCISTLSKQDLTCSGSDDCKAAYIDILGTVLQVQCTCRTITQSEESLCKIFQHMLHRKSCFNYPTLSNVKGMALYTRKHANKITLTGFHSPFNGEVIYAAMCMTVTCGILLLVMVKLRTSRISSKARDPSSIQIPGEL

SEQ ID NO: 1818 - protein, 233 aa, Artificial Sequence
  Construct 2 (IgK-2Flag-GFRAL domain 1)
MDMRVPAQLLGLLLLWLRGARCDYKDDDDKSAGGDYKDDDDKGGQTNNCTYLREQCLRDANGCKHAWRVMEDACNDSDPGDPCKMRNSSYCNLSIQYLVESNFQFKECLCTDDFYCTVNKLLGKKCINKSDNVKEDKFKWNLTTRSHHGFKGMWSFNYPTLSNVKGMALYTRKHANKITLTGFHSPFNGEVIYAAMCMTVTCGILLLVMVKLRTSRISSKARDPSSIQIPGEL

SEQ ID NO: 1819 - protein, 212 aa, Artificial Sequence
  Construct 3 (IgK-2Flag-GFRAL domain 2)
MDMRVPAQLLGLLLLWLRGARCDYKDDDDKSAGGDYKDDDDKGGSHHGFKGMWSCLEVAEACVGDVVCNAQLASYLKACSANGNPCDLKQCQAAIRFFYQNIPFNIAQMLAFCDCAQSDIPCQQSKEALHSKTCFNYPTLSNVKGMALYTRKHANKITLTGFHSPFNGEVIYAAMCMTVTCGILLLVMVKLRTSRISSKARDPSSIQIPGEL

SEQ ID NO: 1820 - protein, 313 aa, Artificial Sequence
  Construct 4 (IgK-2Flag-GFRAL domain 1+2)
MDMRVPAQLLGLLLLWLRGARCDYKDDDDKSAGGDYKDDDDKGGQTNNCTYLREQCLRDANGCKHAWRVMEDACNDSDPGDPCKMRNSSYCNLSIQYLVESNFQFKECLCTDDFYCTVNKLLGKKCINKSDNVKEDKFKWNLTTRSHHGFKGMWSCLEVAEACVGDVVCNAQLASYLKACSANGNPCDLKQCQAAIRFFYQNIPFNIAQMLAFCDCAQSDIPCQQSKEALHSKTCFNYPTLSNVKGMALYTRKHANKITLTGFHSPFNGEVIYAAMCMTVTCGILLLVMVKLRTSRISSKARDPSSIQIPGEL

SEQ ID NO: 1821 - protein, 330 aa, Artificial Sequence
  Construct 5 (IgK-2Flag-GFRAL domain 1+3)
MDMRVPAQLLGLLLLWLRGARCDYKDDDDKSAGGDYKDDDDKGGQTNNCTYLREQCLRDANGCKHAWRVMEDACNDSDPGDPCKMRNSSYCNLSIQYLVESNFQFKECLCTDDFYCTVNKLLGKKCINKSDNVKEDKFKWNLTTRSHHGFKGMWSCLSVIRSCQNDELCRRHYRTFQSKCWQRVTRKCHEDENCISTLSKQDLTCSGSDDCKAAYIDILGTVLQVQCTCRTITQSEESLCKIFQHMLHRKSCFNYPTLSNVKGMALYTRKHANKITLTGFHSPFNGEVIYAAMCMTVTCGILLLVMVKLRTSRISSKARDPSSIQIPGEL

SEQ ID NO: 1822 - protein, 318 aa, Artificial Sequence
  Construct 6 (IgK-2Flag-GFRAL domain 2+3)
MDMRVPAQLLGLLLLWLRGARCDYKDDDDKSAGGDYKDDDDKGGSHHGFKGMWSCLEVAEACVGDVVCNAQLASYLKACSANGNPCDLKQCQAAIRFFYQNIPFNIAQMLAFCDCAQSDIPCQQSKEALHSKTCAVNMVPPPTCLSVIRSCQNDELCRRHYRTFQSKCWQRVTRKCHEDENCISTLSKQDLTCSGSDDCKAAYIDILGTVLQVQCTCRTITQSEESLCKIFQHMLHRKSCFNYPTLSNVKGMALYTRKHANKITLTGFHSPFNGEVIYAAMCMTVTCGILLLVMVKLRTSRISSKARDPSSIQIPGEL

SEQ ID NO: 1823 - protein, 228 aa, Artificial Sequence
  Construct 7 (IgK-2Flag-GFRAL domain 3)
MDMRVPAQLLGLLLLWLRGARCDYKDDDDKSAGGDYKDDDDKGGAVNMVPPPTCLSVIRSCQNDELCRRHYRTFQSKCWQRVTRKCHEDENCISTLSKQDLTCSGSDDCKAAYIDILGTVLQVQCTCRTITQSEESLCKIFQHMLHRKSCFNYPTLSNVKGMALYTRKHANKITLTGFHSPFNGEVIYAAMCMTVTCGILLLVMVKLRTSRISSKARDPSSIQIPGEL

SEQ ID NO: 1824 - protein, 225 aa, Artificial Sequence
  3P10 Fab Hc
QIQLVQSGPELKKPGETVKISCKASGYTFTDYGVIWVKQAPGKALKWMGWINTYTGEPTYADDLKGRFAFSLETSASSASLQINNLKNEDTATYFCARRYGPEDIDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDEVD

SEQ ID NO: 1825 - protein, 218 aa, Artificial Sequence
  3P10 Fab Lc
DIVLTQSPVSLAVSLGQRATISCRASESVDNYGISFMSWFQQKPGQPPKLLIYAASHQGSGVPARFSGSGSGTDFSLNIHPMEEDDSAMYFCLQSKEVPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1826 - protein, 232 aa, Artificial Sequence
  25M22 Fab Hc
QVQLQQSGPDLVKPGASVKISCKASGYTFTSYWVNWMKQRPGKGLEWIGRIYPGDGDTNYNGKFKGKATLTADKSSSTAYMQLSSLTSEDSAVYFCARAYLLRLRRTGYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDEVD

SEQ ID NO: 1827 - protein, 219 aa, Artificial Sequence
  25M22 Fab Lc
DVVLTQTPLSLPVNIGDQASISCKSTKSLLNSDEFTYLDWYLQKPGQSPQLLIFLVSNRFSGVPDRFSGSGSGTDFTLKISRVEAEDLGVYYCFQSNYLPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1828 - protein, 224 aa, Artificial Sequence
  8D8 Fab Hc
QVQLKESGPGLVAPSQSLSITCTVSGFSLSRYSVHWVRQPPGKGLEWLGMIWGFGSTDYNSALKSRLSITKDNSKSQFFLKMNSLQTDDTAMYYCARIHTTAGSYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDEVDG

SEQ ID NO: 1829 - protein, 214 aa, Artificial Sequence
  8D8 Fab Lc
DIVMTQSQKFMSTSIGDRVSVTCKASQNVGTNVAWYQQKPGQSPKALVYSTSYRYSGVPDRFTGSGSGTDFTLTISNVQSEDLAEYFCHQYNSYPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1830 - protein, 230 aa, Artificial Sequence
  5F12 Fab Hc
QVQLKQSGTELVRPGASVKLSCKASGYTFTDYYINWVKQRPGQGLEWIARIYPGNGNTYHNEKFKGKATLTAEKSSSTAYMQLSSLTSEDSAVYFCAREGLYYDYDRYFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDEVDG

SEQ ID NO: 1831 - protein, 218 aa, Artificial Sequence
  5F12 Fab Lc
NIVLTQSPASLAVSLGQRATISCRASESVDTYGNSFMHWYQQKPGQPPKLLIYLASNLESGVPARFSGSGSRTDFTLTIDPVEADDAATYYCHQNNEDPPAFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1832 - protein, 394 aa, Pan troglodytes
  GFRAL protein - Chimpanzee
MIVFIFLAMGLSLENEYTSQTNNCTYLREQCLRDANGCKHAWRVMEDACNDSDPGDPCKMRNSSYCNLSIQYLVESNFQFKECLCTDDFYCTVNKLLGKKCINKSDNVKEDKFKWNLTTRSHHGFKGMWSCLEVAEACVGDVVCNAQLASYLKACSANGNPCDVKQCQAAIRFFYQNIPFNIAQMLAFCDCAQSDIPCQQSKEALHSKTCAVNLVPPPTCLSVIRSCQNDELCRRHYRTFQSKCWQRVTRKCHEDENCISALSKQDLTCSGSDDCKAAYIDILGTVLQVQCTCRTITQSEESLCKIFQHMLHRKSCFNYPTLSNVKGMALYTRKHANKITLTGFHSPFNGEVIYAAMCMTVTCGILLLVMVKLRTSRISSKARDPSPIQIPGEL

SEQ ID NO: 1833 - protein, 395 aa, Ailuropoda melanoleuca
  GFRAL protein - Giant Panda
MVVFIFLAVALCLENESTSETIDCTYLREQCLRDANGCKHAWRIMEDSCNVSEPGNPCKMKDSSKCNLSIQSLVESNFQFEDCLCTDNLYCTINKLLGEQCINESGNVKEDNQSKWNLTTLPYQGIKGIQSCLEVAEACVGDVVCNAQLAPYLKACSANGNLCDVKHCQAAIRFFYQNMPFNIAQMLAFCDCAQSDIPCQQSREALHSKPCAVNVVPPPTCLDVIHSCRNDELCRRRYRTFQSKCWQHVTRKCHEDELCISTLSQQDLICSGSDDCKAAYIGTFGTVLQVQCTCRTITQSEESLCKIFQHMLHRRSCFDYLTLSNVKGMALHKRKPAKEITLSGFHSPFNGEVIYAVMCMTVTCGILLLVMLKLRTSRISSQTRDHSPIRIPGGL

SEQ ID NO: 1834 - protein, 395 aa, Canis familiaris
  GFRAL protein - Dog
MIVFIFLAMVLCLENESTSQTIDCTHLREQCLSDADGCKHAWRIMEYSCNVSVPGNPCKMKDSSNCNLSIQSLVENNFQFEDCLCTDNIYCTINKLLGEQCMNESDNMKEDNQYKWNLTTLPYHGIKGIQSCLEVAEACVGDVVCNTQLAAYLKACSANGNLCDVKHCQAAIRFFYQNMPFNIAQMLAFCDCAPSDIPCQQSKEALHSKPCAVNVVPPPSCLDVIHSCRNDELCRRRYRTFQSKCWQHMIRKCHEDELCISTLSQQDLTCSGSDDCKAAYIGTFGTVLQVQCTCRTTTQNEESLCKIFQHMLHGRSCFDYPTLSNVKGMALHERKHAKEITLSGFHSPFNGEVIYAVMCMTVTCGILLLVMLKLRTSRISSQTRDHSPIQIPGGL

SEQ ID NO: 1835 - protein, 395 aa, Felis catus
  GFRAL protein - Cat
SVLIVISAMVLCLENESTSQTIDCTYLREQCLSDTNGCKLAWRKMEDSCNVSDPGNPCKMKDSSNCNLSIQSLVENNFQFEDCLCTGNLHCTINKLLGKKCINESDNMKEDNQSKWNLTTLPYNGIKGIQSCLEVAEACVGDVVCNAQLAPYLKACSANGNLCDVKHCQAAIRFFYQSMPFNIAQMLAFCDCAPSDIPCQQSKEALHSKPCAVNIVPPPTCLNVIHSCRNDELCRRRYRTFQWKCWQQVTRKCHEDEFCISTLSKQDLTCSGSDDCKAAYIGILGTVLQAQCTCRTITQGEESLCKIFQHMLHRRSCFNYPTLSNVKGIALHKRKHAKEITLSGFHSPFNGEVIYAVMCMTVTCGILLLVMLKLRTSRISSQTRDHSPVQILEEL

SEQ ID NO: 1836 - protein, 324 aa, Bos taurus
  GFRAL protein - Bovine
PLIVVIQAVGLCLNKSASQTTDCTYLRELCLSDADGCKHAWRIMEDACNVSGNTCQMKNSSSCGLSIQSLVESNLQFKDCLCFDDLYCTFNKLLGKKCINESDNIKEDNKYKWNLTTLSYHGGRGVQSCLEVAEVCIGDALCNAQLALYLKACSADGKLCDVKHCQAAIRFFYQNMPFNIAQMLAFCDCAPADEPCQQSREALHSRPCAVNRVPTPTCLDVIHSCQDDELCRRRYRIFQAKCWQHVMRKCHEDETCIGTLSKQDLACSGSDDCKAAYIGTLGTVLQGQCTCRTITQSEESLCKTFQHMLHRKSCFNNKPTQNLK

SEQ ID NO: 1837 - protein, 395 aa, Sus scrofa
  GFRAL protein - Pig
SVIAVLQAVGLYLENESTSQTTDCTYLRELCLNDTDGCKQAWRIMEDACNVSDPGNTCQMKDSSSCNQSIQSLAESNFQFKDCLCSDDLYCTVNNLIGKKCTNESDNMKEDGVFKRNLTAPSYHGIRGIQSCLEVAEACVRDTVCNAQLALYLKACSANGNLCDVKHCQAAIRFFYQNMPFNVAQMLAFCDCAPSDIPCQQSKEALHSKPCALNRVPAPTCLDVIRSCQNDELCRRRYRIFQAKCWQHVTAKCHDDETCISTLNKQDFTCSRSDDCKAAYMGTLGTALQGQCTCRTTTQSEESLCKIFQHMLHGKSCFNYPTLSNVKGIALHKRKHAKEISLSGCQSPFNGEVIYAVMCMTVTCGILLLVMFKLRNFRISSQTRDPSPIQIPGEP

SEQ ID NO: 1838 - protein, 220 aa, Cricetulus griseus
  GFRAL protein - Chinese Hamster (amino acids 169-388)
ACSANGNLCDVKHCQAAIRFFYQNMPFNTAQMLAFCDCAQSDIPCQQSKETLHSKPCALNVVPPPTCLSVIHTCRNDELCRTRYQTFQSECWFHVMGKCHEDETCIGTLGKQDLICSGSDSCRAAYLGTFGTVLQVPCACRSITQDEEPLCMTFQHMLQSKSCFNYPTPNVKDISSYKGKHSKEITLTGFESPFNGELVYAVLCMVVTCGILFLVMLKLR

SEQ ID NO: 1839 - protein, 319 aa, Ornithorhynchus anatinus
  GFRAL protein - Platypus
MKHYFLFVVLMLGFKCESASLTTGCLHLRKQCVSAMDGCESAWAVIEDVCNVSGHNCTMKESLNCNLSIQLLADRYPAFKDCLCAEDISCSATNFLGRKCIIKTENEHKDKNIKSLWNSTSLLQHGFKGTRSCLEVTVACVGDTVCNKQLARFLKDCSTHGSLCNMNQCQAAIRFFYQNIPFNIAQMLAFCDCAQSDIPCQQSKEALHSKPCAVNVVPTPSCLNVIRSCRDDELCRQRFETFQSKCWQDMDKCSDDETCIVTLNKENITCSRNEECREAYIGTLGTYLHVQCTCSTLSLTEEYLCKIFHHILHSRSCFS

SEQ ID NO: 1840 - protein, 168 aa, Cricetulus griseus
  GFRAL protein - Chinese Hamster (amino acids 1-168)
MDVLLNHSFTSFIEESTLPSDLVPRSNVTQGFLREDTFLTAERKDDCVAAAEACQESVHCSLLHENFKKACGKGTAQCHTLSGQQFCVALRESLRETVLWDCQCGFPLEGDCIRIWKGLFEDICIEDTQINQIATFSQDNEDRLKEDIASDNLKKDNKFKWDLTTLHH

SEQ ID NO: 1841 - protein, 308 aa, Macaca mulatta
  GDF15 protein - Rhesus Monkey
MPGQELKTLNGSQMLLVLLVLLWPPHGGAMSLAEASRASFPGPSDLHSEDSRFRELRKRYEDLLTRLRANQSWEDSNTDLIQAPEVRILTPEVRLGSGGHLHLRISRAVLPEGLPEASRIHRALFRLSPTASRSWDVTRPLRRQLRLARPQAPALHLRLSPPPSQSDQLLVKSSSSRPQLELHLRLRAARGRRRARARNGDRCPLGPGRCCRLHTVHASLEDLGWADWVLSPREVQVTMCIGACPSQFREANMHAQIKMNLHRLKPDTVPAPCCVPASYNPMVLIQKTDTGVSLQTYDDLLAKDCHCV

SEQ ID NO: 1842 - protein, 308 aa, Hylobates sp.
  GDF15 protein - Gibbon
MPRQEPRMLNGSQMLLVLLVLSWPPHGGALSLAEASPASFPGPSELHSKDSRFRELRKRYEDLLTRLRVNQSWEDLNTDLVPAPAVRILTPEVRLGSGGHLHLRISRAALPEGLPEASRLHRALFRLSPTASRSWDVTRPLRRQLSLARPQAPALHLRLSPPRSRSDQLLAESSSARPQLELHLRPQAARGRRRARARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 1843 - protein, 308 aa, Pan troglodytes
  GDF15 protein - Chimpanzee
MPRQELRTLNGSQMLLVLLVLSWPPHGGALSLAEASRASFSGPSELHSEDARFRELRKRYEDLLTRLRANQSWEDSNTDLVPAPAVRILTPEVRLGSGGHLHLRISRAALPEGLPEASRLHRALFRLSPTAARSWDVTRPLRRQLSLARPQAPALHLRLSPPPSQSDQLLAESSSARPQLELHLRSRAARGLRRARARNGDHCPLGPGRCCRLHTVRASLEDLGWSDWVLSPREVQVTMCIGACPSQFRAANMHAQIKTSLHRLKPDTVPAPCCVPASYNPMVLIQKTDTGVSLQTYDDLLAKDCHCI

SEQ ID NO: 1844 - protein, 308 aa, Pongo sp.
  GDF15 protein - Orangutan
MPRQELRTLNGFQMLLVLLVLSWPPHGGALSLAEASRASFPGPSDLHSEDSRFRELRKRYEDLLTRLRANQSWEDSNTDLVPAPAVRILTPEVRLGSGGHLHLRISRAALPEGLPEASRLHRALFRLSPTASRSWDVTRLLRRQLSLARPQAPALHLRLSPPPSQSDQLLAESSSARPQLELHLRPRAARGRRRARARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 1845 - protein, 308 aa, Bos taurus
  GDF15 protein - Cow
MPGQRPAAPHRSRMLLMLLMFSWLRSGGALSLTQEHLQTFQGPSNVHSSPDISRFRELRKRYEDLLTRLRANQTWEDSNPDLIPPPQVRIVTPKLRLGPGGHLHLRIPRVNLTEGLPAASRLHRALLRLSPKAWSSWDVTRPLRRQLRLGGSRGPSIRLRLLARPDQLQEALPSAPPQLELHWRPSATRGRRHAHAHTRDGCPLGEGRCCHLQSLRASLEDLGWADWVLAPRELDVRMCIGACPSHFRSANTHAQMQARLHGLNPDAAPAPCCVPASYEPVVLMHQDSDGRVSLTPFDDLVAKDCHCV

SEQ ID NO: 1846 - protein, 308 aa, Sus scrofa
  GDF15 protein - Pig
MPGQLPSPPRRSPTLLMLLMLSWLPSGGALSLAQEHLPALPGPSDVHSSSDVSRFRELRKRYEDLLTRLRANQTWEDSNPNLIPAPQVRIVTPKFRLGPGGHLHLRIPRVNLTEGLPAASRLHRALLRLSPTARSSWDVTRPLRRQLSVGGSRGSAIHLRLLQRPDQLLEALPAGQPQLELHWRPSSTRGRRNTHAHTRDGCPLGTGRCCRLQSLRASLEDLGWADWVLAPRELDVRMCVGACPSHFRSANTHAQMQARLHGLNPDAAPAPCCVPASYEPVVLMHQDSDGRVSLTPFDDLVAKDCHCV

SEQ ID NO: 1847 - protein, 307 aa, Canis familiaris
  GDF15 protein - Dog
MPGQGPAPAHCSPMLVILVMLSWLPSGGALSLAQEHLPAFPGPSDPHSSTDVSRIQELRKRYEHLQTKLRLNQGWADSNPDLVPATRVRILTPKLRLGPRGHLHLRIARADLTAGLPAASRLHRALLRLSPTEPSSWDVTRPLQRQLSRVGSRTPTLRLRLLPRWDRSRALPSARPQLELHWRPRAARGRRNAHAHARDGCPLGEGRCCRLQSLRASLQDLGWANWVVAPRELDVRMCVGACPSQFRSANTHAQMQARLHGLNPDAAPAPCCVPASYEPVVLMHQDSDGRVSLTPFDDLVAKDCHCV

SEQ ID NO: 1848 - protein, 308 aa, Ailuropoda melanoleuca
  GDF15 protein - Giant Panda
MPGQGLTPPPGSPMLLMLLMFSWLPSGGALSLAQEHLPAFPGPSDTHSSTDVSRAQEFRKRYAHLQTRLWLNQSRADSNSDLIPAAQVRILTPKLRLGSGGHLHLRIARADLTEGLPAASRLHRALLRLSPTEPSSWDVTRPLQRQLSLGGSRAPVLRLRLLPQWDPLGATLPSARPQLELHWRPRAARGRRNAHAHGGDGCPLGEGRCCRLQSLRASLEDLGWADWVVAPRELDVRMCVGACPSQFRSANTHAQMQARLHGLNPEAAPAPCCVPASYEPVVLMHQDSDGRVSLTPFDDLVAKDCHCV

SEQ ID NO: 1849 - protein, 298 aa, Mustela furo
  GDF15 protein - Ferret
HSSPMLPVLLMFSWLPSGGALSLAQERLPAFPGPSDAHSSMDISRAQEFRKHYEHLQTRLRLNQSWGDSNSDLNLTAPVRILTPKLRLGPGGHLHLRIALADLTEGLPATSRLHQALLRLSPMEPSSWDVTRPLQRQLSLGGSRASALHLRLLPRLNRLRATLPSARPQLELHWRPSAARGRRDAHAHAGDGCPLGEGRCCRLQSLRASLEDLGWANWVVAPRELDVRMCIGACPSQFRSANTHAQMQARLHGLNPDAAPAPCCVPASYEPVVLLHQDSDGRVSLTPFDDLVAKDCHC

SEQ ID NO: 1850 - protein, 303 aa, Mus musculus
  GDF15 protein - Mouse
MAPPALQAQPPGGSQLRFLLFLLLLLLLLSWPSQGDALAMPEQRPSGPESQLNADELRGRFQDLLSRLHANQSREDSNSEPSPDPAVRILSPEVRLGSHGQLLLRVNRASLSQGLPEAYRVHRALLLLTPTARPWDITRPLKRALSLRGPRAPALRLRLTPPPDLAMLPSGGTQLELRLRVAAGRGRRSAHAHPRDSCPLGPGRCCHLETVQATLEDLGWSDWVLSPRQLQLSMCVGECPHLYRSANTHAQIKARLHGLQPDKVPAPCCVPSSYTPVVLMHRTDSGVSLQTYDDLVARGCHCA

SEQ ID NO: 1851 - protein, 301 aa, Cavia porcellus
  GDF15 protein - Guinea Pig
MPALGFTLLLLAAVSRPPPGGASGPAEKLPAEPDPDLDPDRDPDPAAHPARELRRRFEDLLARLRANRSADALPAERSPAPVVHTLTPDVRRGHDGSLHLRIPRASLPPGVPRASRVQHALLRLSPETREPWDVTRPLQRQLRLLDPRAPALLLHLWPPSDRWRELSSAPPRLELHLRTRSARGRRSTRMRTRDDCPLGPGRCCRLHTVRASLQDLGWTDWVLSPRELHVGICMGECPSLYRSANTHAQVKARLHGLKPDSVPAPCCVPSSYDLVVLMHKTDGGIALHTYDDLIAKGCHCA

SEQ ID NO: 1852 - protein, 113 aa, Artificial Sequence; identical to SEQ ID NO: 2
  VL Domain (1C1)

SEQ ID NO: 1853 - protein, 111 aa, Artificial Sequence; identical to SEQ ID NO: 4
  VL Domain (3P10)

SEQ ID NO: 1854 - protein, 107 aa, Artificial Sequence; identical to SEQ ID NO: 6
  VL Domain (12A3)

SEQ ID NO: 1855 - protein, 106 aa, Artificial Sequence; identical to SEQ ID NO: 26
  VL Domain (1B3)

SEQ ID NO: 1856 - protein, 103 aa, Artificial Sequence; identical to SEQ ID NO: 30
  VL Domain (2B3)

SEQ ID NO: 1857 - protein, 107 aa, Artificial Sequence; identical to SEQ ID NO: 40
  VL Domain (2B11)

SEQ ID NO: 1858 - protein, 107 aa, Artificial Sequence; identical to SEQ ID NO: 18
  VL Domain (2B8)

SEQ ID NO: 1859 - protein, 107 aa, Artificial Sequence; identical to SEQ ID NO: 20
  VL Domain (22N5)

SEQ ID NO: 1860 - protein, 106 aa, Artificial Sequence; identical to SEQ ID NO: 483
  VL Domain (P1B6)

SEQ ID NO: 1861 - protein, 106 aa, Artificial Sequence; identical to SEQ ID NO: 487
  VL Domain (P8G4)

SEQ ID NO: 1862 - protein, 107 aa, Artificial Sequence; identical to SEQ ID NO: 12
  VL Domain (8D8)

SEQ ID NO: 1863 - protein, 106 aa, Artificial Sequence; identical to SEQ ID NO: 34
  VL Domain (2A9)

SEQ ID NO: 1864 - protein, 107 aa, Artificial Sequence; identical to SEQ ID NO: 32
  VL Domain (8C10)

SEQ ID NO: 1865 - protein, 108 aa, Artificial Sequence; identical to SEQ ID NO: 36
  VL Domain (24G2)

SEQ ID NO: 1866 - protein, 112 aa, Artificial Sequence; identical to SEQ ID NO: 22
  VL Domain (2J23)

SEQ ID NO: 1867 - protein, 112 aa, Artificial Sequence; identical to SEQ ID NO: 24
  VL Domain (6N16)

SEQ ID NO: 1868 - protein, 112 aa, Artificial Sequence; identical to SEQ ID NO: 10
  VL Domain (5A20)

SEQ ID NO: 1869 - protein, 112 aa, Artificial Sequence; identical to SEQ ID NO: 14
  VL Domain (17J16)

SEQ ID NO: 1870 - protein, 112 aa, Artificial Sequence; identical to SEQ ID NO: 481
  VL Domain (1A3)

SEQ ID NO: 1871 - protein, 112 aa, Artificial Sequence; identical to SEQ ID NO: 485
  VL Domain (P1H8)

SEQ ID NO: 1872 - protein, 112 aa, Artificial Sequence; identical to SEQ ID NO: 16
  VL Domain (25M22)

SEQ ID NO: 1873 - protein, 112 aa, Artificial Sequence; identical to SEQ ID NO: 28
  VL Domain (19K19)

SEQ ID NO: 1874 - protein, 111 aa, Artificial Sequence; identical to SEQ ID NO: 8
  VL Domain (5F12)

SEQ ID NO: 1875 - protein, 111 aa, Artificial Sequence; identical to SEQ ID NO: 38
  VL Domain (6G9)

SEQ ID NO: 1876 - protein, 118 aa, Artificial Sequence; identical to SEQ ID NO: 480
  VH Domain (1A3)

SEQ ID NO: 1877 - protein, 117 aa, Artificial Sequence; identical to SEQ ID NO: 482
  VH Domain (P1B6)

SEQ ID NO: 1878 - protein, 117 aa, Artificial Sequence; identical to SEQ ID NO: 484
  VH Domain (P1H8)

SEQ ID NO: 1879 - protein, 113 aa, Artificial Sequence; identical to SEQ ID NO: 486
  VH Domain (P8G4)

SEQ ID NO: 1880 - protein, 112 aa, Artificial Sequence; identical to SEQ ID NO: 481
  VL Domain (1A3)

SEQ ID NO: 1881 - protein, 106 aa, Artificial Sequence; identical to SEQ ID NO: 483
  VL Domain (P1B6)

SEQ ID NO: 1882 - protein, 112 aa, Artificial Sequence; identical to SEQ ID NO: 485
  VL Domain (P1H8)

SEQ ID NO: 1883 - protein, 106 aa, Artificial Sequence; identical to SEQ ID NO: 487
  VL Domain (P8G4)

SEQ ID NO: 1884 - protein, 121 aa, Artificial Sequence
  VH Domain (1C1)
QMQLKQSGPGLVQPSQSLSITCTVSGFSLNDYGVHWIRQSPGKGLEWLGVIWSGGRTDYNAAFISRLSISKDNSKSQVFFKMSSLQPNDTAIYYCARWALYFLYGGSMDYWGQGTSVTVSS

SEQ ID NO: 1885 - protein, 119 aa, Artificial Sequence; identical to SEQ ID NO: 33
  VH Domain (2A9)

SEQ ID NO: 1886 - protein, 120 aa, Artificial Sequence; identical to SEQ ID NO: 21
  VH Domain (2J23)

SEQ ID NO: 1887 - protein, 118 aa, Artificial Sequence; identical to SEQ ID NO: 9
  VH Domain (5A20)

SEQ ID NO: 1888 - protein, 122 aa, Artificial Sequence; identical to SEQ ID NO: 31
  VH Domain (8C10)

SEQ ID NO: 1889 - protein, 116 aa, Artificial Sequence; identical to SEQ ID NO: 11
  VH Domain (8D8)

SEQ ID NO: 1890 - protein, 114 aa, Artificial Sequence; identical to SEQ ID NO: 5
  VH Domain (12A3)

SEQ ID NO: 1891 - protein, 118 aa, Artificial Sequence; identical to SEQ ID NO: 13
  VH Domain (17J16)

SEQ ID NO: 1892 - protein, 125 aa, Artificial Sequence; identical to SEQ ID NO: 15
  VH Domain (25M22)

SEQ ID NO: 1893 - protein, 125 aa, Artificial Sequence; identical to SEQ ID NO: 27
  VH Domain (19K19)

SEQ ID NO: 1894 - protein, 114 aa, Artificial Sequence; identical to SEQ ID NO: 19
  VH Domain (22N5)

SEQ ID NO: 1895 - protein, 113 aa, Artificial Sequence; identical to SEQ ID NO: 2
  VL Domain (1C1)

SEQ ID NO: 1896 - protein, 106 aa, Artificial Sequence; identical to SEQ ID NO: 34
  VL Domain (2A9)

SEQ ID NO: 1897 - protein, 112 aa, Artificial Sequence; identical to SEQ ID NO: 22
  VL Domain (2J23)

SEQ ID NO: 1898 - protein, 112 aa, Artificial Sequence; identical to SEQ ID NO: 10
  VL Domain (5A20)

SEQ ID NO: 1899 - protein, 107 aa, Artificial Sequence; identical to SEQ ID NO: 32
  VL Domain (8C10)

SEQ ID NO: 1900 - protein, 107 aa, Artificial Sequence; identical to SEQ ID NO: 12
  VL Domain (8D8)

SEQ ID NO: 1901 - protein, 107 aa, Artificial Sequence; identical to SEQ ID NO: 6
  VL Domain (12A3)

SEQ ID NO: 1902 - protein, 112 aa, Artificial Sequence; identical to SEQ ID NO: 14
  VL Domain (17J16)

SEQ ID NO: 1903 - protein, 112 aa, Artificial Sequence; identical to SEQ ID NO: 16
  VL Domain (25M22)

SEQ ID NO: 1904 - protein, 112 aa, Artificial Sequence; identical to SEQ ID NO: 28
  VL Domain (19K19)

SEQ ID NO: 1905 - protein, 107 aa, Artificial Sequence; identical to SEQ ID NO: 20
  VL Domain (22N5)

SEQ ID NO: 1906 - protein, 119 aa, Artificial Sequence; identical to SEQ ID NO: 25
  VH Domain (1B3)

SEQ ID NO: 1907 - protein, 119 aa, Artificial Sequence; identical to SEQ ID NO: 39
  VH Domain (2B11)

SEQ ID NO: 1908 - protein, 118 aa, Artificial Sequence; identical to SEQ ID NO: 3
  VH Domain (3P10)

SEQ ID NO: 1909 - protein, 122 aa, Artificial Sequence; identical to SEQ ID NO: 7
  VH Domain (5F12)

SEQ ID NO: 1910 - protein, 120 aa, Artificial Sequence; identical to SEQ ID NO: 37
  VH Domain (6G9)

SEQ ID NO: 1911 - protein, 120 aa, Artificial Sequence; identical to SEQ ID NO: 23
  VH Domain (6N16)

SEQ ID NO: 1912 - protein, 106 aa, Artificial Sequence; identical to SEQ ID NO: 26
  VL Domain (1B3)

SEQ ID NO: 1913 - protein, 107 aa, Artificial Sequence; identical to SEQ ID NO: 40
  VL Domain (2B11)

SEQ ID NO: 1914 - protein, 111 aa, Artificial Sequence; identical to SEQ ID NO: 4
  VL Domain (3P10)

SEQ ID NO: 1915 - protein, 111 aa, Artificial Sequence; identical to SEQ ID NO: 8
  VL Domain (5F12)

SEQ ID NO: 1916 - protein, 111 aa, Artificial Sequence; identical to SEQ ID NO: 38
  VL Domain (6G9)

SEQ ID NO: 1917 - protein, 112 aa, Artificial Sequence; identical to SEQ ID NO: 24
  VL Domain (6N16)

SEQ ID NO: 1918 - protein, 121 aa, Artificial Sequence; identical to SEQ ID NO: 1884
  VH Domain (1C1)

SEQ ID NO: 1919 - protein, 121 aa, Artificial Sequence
  VH Domain (HC-349a)
QVQLQESGPGLVKPSETLSLTCTVSGFSLNDYGVHWIRQPPGKGLEWIGVIWSGGRTDYNAAFISRVTISVDTSKNQFSLKLSSVTAADTAVYYCARWALYFLYGGSMDYWGQGTLVTVSS

SEQ ID NO: 1920 - protein, 121 aa, Artificial Sequence
  VH Domain (HC-349b)
QVQLQESGPGLVKPSETLSLTCTVSGFSLNDYGVHWIRQPPGKGLEWIGVIWSGGRTDYNAAFISRVTISKDTSKNQFSLKLSSVTAADTAVYYCARWALYFLYGGSMDYWGQGTLVTVSS

SEQ ID NO: 1921 - protein, 121 aa, Artificial Sequence
  VH Domain (HC-349c)
QMQLQESGPGLVKPSETLSLTCTVSGFSLNDYGVHWIRQPPGKGLEWIGVIWSGGRTDYNAAFISRLTISVDTSKNQVSLKLSSVQAADTAVYYCARWALYFLYGGSMDYWGQGTLVTVSS

SEQ ID NO: 1922 - protein, 121 aa, Artificial Sequence
  VH Domain (HC-349d)
QMQLQESGPGLVKPSETLSLTCTVSGFSLNDYGVHWIRQPPGKGLEWIGVIWSGGRTDYNAAFISRVTISKDNSKSQFSLKLSSVTAQDTAVYYCARWALYFLYGGSMDYWGQGTLVTVSS

SEQ ID NO: 1923 - protein, 121 aa, Artificial Sequence
  VH Domain (HC-349e)
QMQLQESGPGLVKPSETLSLTCTVSGFSLNDYGVHWIRQPPGKGLEWIGVIWSGGRTDYNAAFISRLTISKDTSKNQFSLKMSSVTAADTAVYYCARWALYFLYGGSMDYWGQGTLVTVSS

SEQ ID NO: 1924 - protein, 121 aa, Artificial Sequence
  VH Domain (HC-349f)
QMQLQESGPGLVKPSETLSLTCTVSGFSLNDYGVHWIRQPPGKGLEWLGVIWSGGRTDYNAAFISRLTISKDTSKNQVSFKMSSLTAADTAVYYCARWALYFLYGGSMDYWGQGTLVTVSS

SEQ ID NO: 1925 - protein, 121 aa, Artificial Sequence
  VH Domain (HC-350a)
QVQLQESGPGLVKPSETLSLTCTVSGFSLNDYGVHWIRQPPGKGLEWIGVIWSGGRTDYNAAFISRVTISRDTSKNQFSLKLSSVTAADTAVYYCARWALYFLYGGSMDYWGQGTLVTVSS

SEQ ID NO: 1926 - protein, 121 aa, Artificial Sequence
  VH Domain (HC-350b)
QMQLQESGPGLVKPSETLSLTCTVSGFSLNDYGVHWIRQPPGKGLEWIGVIWSGGRTDYNAAFISRVTISRDTSKSQFSLKLSSVTAADTAVYYCARWALYFLYGGSMDYWGQGTLVTVSS

SEQ ID NO: 1927 - protein, 121 aa, Artificial Sequence
  VH Domain (HC-350c)
QMQLQESGPGLVKPSETLSLTCTVSGFSLNDYGVHWIRQPPGKGLEWIGVIWSGGRTDYNAAFISRLTISRDTSKSQVSFKLSSVTAADTAVYYCARWALYFLYGGSMDYWGQGTLVTVSS

SEQ ID NO: 1928 - protein, 113 aa, Artificial Sequence; identical to SEQ ID NO: 2
  VL Domain

SEQ ID NO: 1929 - protein, 113 aa, Artificial Sequence
  VL Domain (LC-349a)
DVVMTQSPLSLPVTLGQPASISCRSSQSLVHSSGITYLHWFQQRPGQSPRRLIYKLSNRFSGVPDRFSGSGSGTDFTLKISRVEAEDVGVYYCSQSTHVPPWTFGGGTKVEIK

SEQ ID NO: 1930 - protein, 113 aa, Artificial Sequence
  VL Domain (LC-349b)
DVVLTQSPLSLPVTLGQPASISCRSSQSLVHSSGITYLHWYQQRPGQSPRRLIYKLSNRFSGVPDRFSGSGSGTDFTLKISRVEAEDVGVYYCSQSTHVPPWTFGGGTKVEIK

SEQ ID NO: 1931 - protein, 113 aa, Artificial Sequence
  VL Domain (LC-349c)
DVVLTQSPLSLPVTLGQPASISCRSSQSLVHSSGITYLHWYQQRPGQSPKLLIYKLSNRFSGVPDRFSGSGSGTDFTLKISRVEAEDVGVYYCSQSTHVPPWTFGGGTKVEIK

SEQ ID NO: 1932 - protein, 113 aa, Artificial Sequence
  VL Domain (LC-349d)
DVVLTQSPLSLPVTLGDPASISCRSSQSLVHSSGITYLHWYQQKPGQSPKLLIYKLSNRFSGVPDRFSGSGSGTDFTLKISRVEAEDVGVYYCSQSTHVPPWTFGGGTKVEIK

SEQ ID NO: 1933 - protein, 113 aa, Artificial Sequence; identical to SEQ ID NO: 2
  VL Domain (LC-350a)

SEQ ID NO: 1934 - protein, 113 aa, Artificial Sequence
  VL Domain (LC-350b)
DIVMTQTPLSLPVSPGDQASISCRSSQSLVHSSGITYLHWYLQKPGQSPKLLIYKLSNRFSGVPDRFSGSGSGTDFTLKISRVEAEDLGVYFCSQSTHVPPWTFGGGTKLEIK

SEQ ID NO: 1935 - protein, 125 aa, Artificial Sequence; identical to SEQ ID NO: 15
  VH Domain (25M22)

SEQ ID NO: 1936 - protein, 125 aa, Artificial Sequence
  VH Domain (HC-389a)
EVQLVQSGAEVKKPGESLKISCKGSGYTFTSYWVNWVRQMPGKGLEWMGRIYPGDGDTNYNGKFKGQVTISADKSISTAYLQWSSLKASDTAMYYCARAYLLRLRRTGYYAMDYWGQGTTVTVSS

SEQ ID NO: 1937 - protein, 125 aa, Artificial Sequence
  VH Domain (HC-389b)
EVQLVQSGAEVKKPGESLKISCKGSGYTFTSYWVNWVRQMPGKGLEWIGRIYPGDGDTNYNGKFKGQATISADKSISTAYLQWSSLKASDTAMYYCARAYLLRLRRTGYYAMDYWGQGTTVTVSS

SEQ ID NO: 1938 - protein, 125 aa, Artificial Sequence
  VH Domain (HC-389c)
EVQLVQSGAEVKKPGESLKISCKGSGYTFTSYWVNWVRQMPGKGLEWIGRIYPGDGDTNYNGKFKGQATLSADKSISTAYLQWSSLKASDTAMYYCARAYLLRLRRTGYYAMDYWGQGTTVTVSS

SEQ ID NO: 1939 - protein, 125 aa, Artificial Sequence
  VH Domain (HC-390a)
QVQLVQSGAEVKKPGSSVKVSCKASGYTFTSYWVNWVRQAPGQGLEWMGRIYPGDGDTNYNGKFKGRVTITADESTSTAYMELSSLRSEDTAVYYCARAYLLRLRRTGYYAMDYWGQGTTVTVSS

SEQ ID NO: 1940 - protein, 125 aa, Artificial Sequence
  VH Domain (HC-390b)
QVQLVQSGAEVKKPGSSVKVSCKASGYTFTSYWVNWVRQAPGQGLEWIGRIYPGDGDTNYNGKFKGRATITADESTSTAYMELSSLRSEDTAVYYCARAYLLRLRRTGYYAMDYWGQGTTVTVSS

SEQ ID NO: 1941 - protein, 125 aa, Artificial Sequence
  VH Domain (HC-390c)
QVQLVQSGAEVKKPGSSVKVSCKASGYTFTSYWVNWVRQAPGQGLEWIGRIYPGDGDTNYNGKFKGRATLTADKSTSTAYMELSSLRSEDTAVYYCARAYLLRLRRTGYYAMDYWGQGTTVTVSS

SEQ ID NO: 1942 - protein, 112 aa, Artificial Sequence; identical to SEQ ID NO: 16
  VL Domain (25M22)

SEQ ID NO: 1943 - protein, 112 aa, Artificial Sequence
  VL Domain (LC-389a)
DVVMTQSPLSLPVTLGQPASISCKSTKSLLNSDEFTYLDWFQQRPGQSPRRLIYLVSNRFSGVPDRFSGSGSGTDFTLKISRVEAEDVGVYYCFQSNYLPYTFGGGTKVEIK

SEQ ID NO: 1944 - protein, 112 aa, Artificial Sequence
  VL Domain (LC-389b)
DVVLTQSPLSLPVTLGQPASISCKSTKSLLNSDEFTYLDWFQQRPGQSPRLLIYLVSNRFSGVPDRFSGSGSGTDFTLKISRVEAEDVGVYYCFQSNYLPYTFGGGTKVEIK

SEQ ID NO: 1945 - protein, 112 aa, Artificial Sequence
  VL Domain (LC-389c)
DVVLTQSPLSLPVTLGQPASISCKSTKSLLNSDEFTYLDWYQQRPGQSPRLLIFLVSNRFSGVPDRFSGSGSGTDFTLKISRVEAEDVGVYYCFQSNYLPYTFGGGTKVEIK

SEQ ID NO: 1946 - protein, 112 aa, Artificial Sequence
  VL Domain (LC-390a)
EIVLTQSPGTLSLSPGERATLSCKSTKSLLNSDEFTYLDWYQQKPGQAPRLLIYLVSNRFSGIPDRFSGSGSGTDFTLTISRLEPEDFAVYYCFQSNYLPYTFGGGTKVEIK

SEQ ID NO: 1947 - protein, 112 aa, Artificial Sequence
  VL Domain (LC-390b)
EVVLTQSPGTLSLSPGERATLSCKSTKSLLNSDEFTYLDWYQQKPGQAPRLLIFLVSNRFSGIPDRFSGSGSGTDFTLTISRLEPEDFAVYYCFQSNYLPYTFGGGTKVEIK

SEQ ID NO: 1948 - protein, 118 aa, Artificial Sequence; identical to SEQ ID NO: 13
  VH Domain (17J16)

SEQ ID NO: 1949 - protein, 118 aa, Artificial Sequence
  VH Domain (HC-356a)
QVQLVQSGAEVKKPGSSVKVSCKASGYTFTDYWIHWVRQAPGQGLEWMGYINPNSNYAEYNQKFKVRVTITADESTSTAYMELSSLRSEDTAVYYCARFDWNWYFHVWGQGTTVTVSS

SEQ ID NO: 1950 - protein, 118 aa, Artificial Sequence
  VH Domain (HC-356b)
QVQLVQSGAEVKKPGSSVKVSCKASGYTFTDYWIHWVRQAPGQGLEWIGYINPNSNYAEYNQKFKVRVTITADESTSTAYMELSRLRSEDTAVYYCARFDWNWYFHVWGQGTTVTVSS

SEQ ID NO: 1951 - protein, 118 aa, Artificial Sequence
  VH Domain (HC-356c)
QVQLVQSGAEVKKPGSSVKVSCKASGYTFTDYWIHWVRQAPGQGLEWIGYINPNSNYAEYNQKFKVRATLTADESTSTAYLELSRLRSEDTAVYYCARFDWNWYFHVWGQGTTVTVSS

SEQ ID NO: 1952 - protein, 118 aa, Artificial Sequence
  VH Domain (HC-356d)
QVQLVQSGAEVKKPGSSVKVSCKASGYTFTDYWIHWVKQAPGQGLEWIGYINPNSNYAEYNQKFKVRATLTADESSSTAYLELSRLRSEDTAVYYCARFDWNWYFHVWGQGTTVTVSS

SEQ ID NO: 1953 - protein, 112 aa, Artificial Sequence; identical to SEQ ID NO: 14
  VL Domain (17J16)

SEQ ID NO: 1954 - protein, 112 aa, Artificial Sequence
  VL Domain (LC-356a)
DVVMTQSPLSLPVTLGQPASISCKSSQSLSDSDGKTYLNWFQQRPGQSPRRLIYLVSRLGSGVPDRFSGSGSGTDFTLKISRVEAEDVGVYYCWQGTHFPQTFGGGTKVEIK

SEQ ID NO: 1955 - protein, 112 aa, Artificial Sequence
  VL Domain (LC-356b)
DVVLTQSPLSLPVTLGQPASISCKSSQSLSDSDGKTYLNWLQQRPGQSPRRLIYLVSRLGSGVPDRFSGSGSGTDFTLKISRVEAEDVGVYYCWQGTHFPQTFGGGTKVEIK

SEQ ID NO: 1956 - protein, 112 aa, Artificial Sequence
  VL Domain (LC-356c)
DVALTQSPLSLPVTLGQPASISCKSSQSLSDSDGKTYLNWLQQRPGQSPKRLIYLVSRLGSGVPDRFSGSGSGADFTLKISRVEAEDVGVYYCWQGTHFPQTFGGGTKVEIK

SEQ ID NO: 1957 - protein, 122 aa, Artificial Sequence; identical to SEQ ID NO: 7
  VH Domain (5F12)

SEQ ID NO: 1958 - protein, 122 aa, Artificial Sequence
  VH Domain (HC-375a)
QVQLVQSGAEVKKPGSSVKVSCKASGYTFTDYYINWVRQAPGQGLEWMGRIYPGNGNTYHNEKFKGRVTITADESTSTAYMELSSLRSEDTAVYYCAREGLYYDYDRYFDYWGQGTLVTVSS

SEQ ID NO: 1959 - protein, 122 aa, Artificial Sequence
  VH Domain (HC-375b)
QVQLVQSGAEVKKPGSSVKVSCKASGYTFTDYYINWVRQAPGQGLEWIGRIYPGNGNTYHNEKFKGRVTITADESTSTAYMELSSLRSEDTAVYYCAREGLYYDYDRYFDYWGQGTLVTVSS

SEQ ID NO: 1960 - protein, 122 aa, Artificial Sequence
  VH Domain (HC-375c)
QVQLVQSGAEVKKPGSSVKVSCKASGYTFTDYYINWVRQAPGQGLEWIGRIYPGNGNTYHNEKFKGRVTITADKSTSTAYMELSSLRSEDTAVYYCAREGLYYDYDRYFDYWGQGTLVTVSS

SEQ ID NO: 1961 - protein, 122 aa, Artificial Sequence
  VH Domain (HC-375d)
QVQLVQSGAEVKKPGSSVKVSCKASGYTFTDYYINWVRQAPGQGLEWIGRIYPGNGNTYHNEKFKGRATLTADKSTSTAYMELSSLRSEDTAVYYCAREGLYYDYDRYFDYWGQGTLVTVSS

SEQ ID NO: 1962 - protein, 122 aa, Artificial Sequence
  VH Domain (HC-375e)
QVQLVQSGAEVKKPGSSVKVSCKASGYTFTDYYINWVRQAPGQGLEWMGRIYPGNGNTYHNEKFKGRATLTADESTSTAYMELSSLRSEDTAVYYCAREGLYYDYDRYFDYWGQGTLVTVSS

SEQ ID NO: 1963 - protein, 122 aa, Artificial Sequence
  VH Domain (HC-375f)
QVQLVQSGAEVVKPGSSVKVSCKASGYTFTDYYINWVKQAPGQGLEWIGRIYPGNGNTYHNEKFKGRATLTADESTSTAYMELSSLRSEDTAVYYCAREGLYYDYDRYFDYWGQGTLVTVSS

SEQ ID NO: 1964 - protein, 122 aa, Artificial Sequence
  VH Domain (HC-375g)
QVQLVQSGAEVKKPGSSVKVSCKASGYTFTDYYINWVRQAPGQGLEWIARIYPGNGNTYHNEKFKGRATLTADKSTSTAYMELSSLRSEDTAVYYCAREGLYYDYDRYFDYWGQGTLVTVSS

SEQ ID NO: 1965 - protein, 122 aa, Artificial Sequence
  VH Domain (HC-375h)
QVQLVQSGAEVKKPGASVKVSCKASGYTFTDYYINWVRQAPGQRLEWIARIYPGNGNTYHNEKFKGRATLTRDKSASTAYMELSSLRSEDTAVYYCAREGLYYDYDRYFDYWGQGTLVTVSS

SEQ ID NO: 1966 - protein, 111 aa, Artificial Sequence; identical to SEQ ID NO: 8
  VL Domain (5F12)

SEQ ID NO: 1967 - protein, 111 aa, Artificial Sequence
  VL Domain (LC-375a)
DIVMTQSPDSLAVSLGERATINCRASESVDTYGNSFMHWYQQKPGQPPKLLIYLASNLESGVPDRFSGSGSGTDFTLTISSLQAEDVAVYYCHQNNEDPPAFGGGTKVEIK

SEQ ID NO: 1968 - protein, 111 aa, Artificial Sequence
  VL Domain (LC-375b)
DIVLTQSPDSLAVSLGERATINCRASESVDTYGNSFMHWYQQKPGQPPKLLIYLASNLESGVPDRFSGSGSGTDFTLTISSVQAEDVAVYYCHQNNEDPPAFGGGTKVEIK

SEQ ID NO: 1969 - protein, 111 aa, Artificial Sequence
  VL Domain (LC-375g)
DIVLTQSPDSLAVSLGERATINCRASESVDTYGNSFMHWYQQKPGQPPKLLIYLASNLESGVPDRFSGSGSRTDFTLTISSLQAEDVAVYYCHQNNEDPPAFGGGTKVEIK

SEQ ID NO: 1970 - protein, 111 aa, Artificial Sequence
  VL Domain (LC-375c)
DIQMTQSPSSLSASVGDRVTITCRASESVDTYGNSFMHWYQQKPGKAPKLLIYLASNLESGVPSRFSGSGSGTDFTLTISSLQPEDFATYYCHQNNEDPPAFGGGTKVEIK

SEQ ID NO: 1971 - protein, 111 aa, Artificial Sequence
  VL Domain (LC-375d)
DIQLTQSPSSLSASVGDRVTITCRASESVDTYGNSFMHWYQQKPGKAPKLLIYLASNLESGVPSRFSGSGSGTDFTLTISSVQPEDFATYYCHQNNEDPPAFGGGTKVEIK

SEQ ID NO: 1972 - protein, 111 aa, Artificial Sequence
  VL Domain (LC-375e)
EIVLTQSPATLSLSPGERATLSCRASESVDTYGNSFMHWYQQKPGQAPRLLIYLASNLESGIPARFSGSGSGTDFTLTISSLEPEDFAVYYCHQNNEDPPAFGGGTKVEIK

SEQ ID NO: 1973 - protein, 111 aa, Artificial Sequence
  VL Domain (LC-375f)
EIVLTQSPATLSVSPGERATLSCRASESVDTYGNSFMHWYQQKPGQAPRLLIYLASNLESGVPARFSGSGSGTDFTLTISSVEPEDFAVYYCHQNNEDPPAFGGGTKVEIK

SEQ ID NO: 1974 - protein, 111 aa, Artificial Sequence
  VL Domain (LC-375h)
DVVMTQSPLSLPVTLGQPASISCRASESVDTYGNSFMHWFQQRPGQSPRRLIYLASNLESGVPDRFSGSGSGTDFTLKISRVEAEDVGVYYCHQNNEDPPAFGGGTKVEIK

SEQ ID NO: 1975 - protein, 111 aa, Artificial Sequence
  VL Domain (LC-375i)
DVVLTQSPLSLPVTLGQPASISCRASESVDTYGNSFMHWFQQRPGQSPRLLIYLASNLESGVPDRFSGSGSGTDFTLKISRVEAEDVGVYYCHQNNEDPPAFGGGTKVEIK

SEQ ID NO: 1976 - protein, 111 aa, Artificial Sequence
  VL Domain (LC-375j)
DIVLTQSPLSLPVTLGQPASISCRASESVDTYGNSFMHWYQQRPGQSPRLLIYLASNLESGVPDRFSGSGSRTDFTLKISRVEAEDVGVYYCHQNNEDPPAFGGGTKVEIK

SEQ ID NO: 1977 - protein, 118 aa, Artificial Sequence; identical to SEQ ID NO: 3
  VH Domain (3P10)

SEQ ID NO: 1978 - protein, 118 aa, Artificial Sequence
  VH Domain (HC-344a)
QVQLVQSGAEVKKPGSSVKVSCKASGYTFTDYGVIWVRQAPGQGLEWMGWINTYTGEPTYADDLKGRVTITADESTSTAYMELSSLRSEDTAVYYCARRYGPEDIDYWGQGTTVTVSS

SEQ ID NO: 1979 - protein, 118 aa, Artificial Sequence
  VH Domain (HC-344b)
QIQLVQSGAEVKKPGSSVKVSCKASGYTFTDYGVIWVRQAPGQGLKWMGWINTYTGEPTYADDLKGRFTITLDESTSTAYMELSSLRSEDTAVYYCARRYGPEDIDYWGQGTTVTVSS

SEQ ID NO: 1980 - protein, 118 aa, Artificial Sequence
  VH Domain (HC-344c)
QIQLVQSGAEVKKPGSSVKVSCKASGYTFTDYGVIWVRQAPGQGLKWMGWINTYTGEPTYADDLKGRFTFTLDESTSTAYMELSSLRSEDTAVYYCARRYGPEDIDYWGQGTTVTVSS

SEQ ID NO: 1981 - protein, 118 aa, Artificial Sequence
  VH Domain (HC-344d)
QIQLVQSGAEVKKPGSSVKVSCKASGYTFTDYGVIWVRQAPGKALKWMGWINTYTGEPTYADDLKGRVTFTADESTSTAYMELSNLRSEDTAVYFCARRYGPEDIDYWGQGTTVTVSS

SEQ ID NO: 1982 - protein, 118 aa, Artificial Sequence
  VH Domain (HC-344e)
QVQLVQSGAEVKKPGSSVKVSCKASGYTFTDYGVIWVRQAPGQGLEWMGWINTYTGEPTYADDLKGRVTFTADESTSTAYMELSSLRSEDTAVYYCARRYGPEDIDYWGQGTTVTVSS

SEQ ID NO: 1983 - protein, 118 aa, Artificial Sequence
  VH Domain (HC-344f)
QVQLVQSGAEVKKPGSSVKVSCKASGYTFTDYGVIWVRQAPGQGLKWMGWINTYTGEPTYADDLKGRVTITADESTSTAYMELSSLRSEDTAVYYCARRYGPEDIDYWGQGTTVTVSS

SEQ ID NO: 1984 - protein, 118 aa, Artificial Sequence
  VH Domain (HC-344g)
QVQLVQSGAEVKKPGSSVKVSCKASGYTFTDYGVIWVRQAPGQGLKWMGWINTYTGEPTYADDLKGRVTFTADESTSTAYMELSSLRSEDTAVYYCARRYGPEDIDYWGQGTTVTVSS

SEQ ID NO: 1985 - protein, 118 aa, Artificial Sequence
  VH Domain (HC-344h)
QIQLVQSGAEVKKPGSSVKVSCKASGYTFTDYGVIWVRQAPGQGLKWMGWINTYTGEPTYADDLKGRVTFTADESTSTAYMELSSLRSEDTAVYYCARRYGPEDIDYWGQGTTVTVSS

SEQ ID NO: 1986 - protein, 118 aa, Artificial Sequence
  VH Domain (HC-345a)
QVQLVQSGAEVKKPGATVKISCKVSGYTFTDYGVIWMQQAPGKGLEWIGWINTYTGEPTYADDLKGRVTLTADTSTDTAYMELSSLRSEDTAVYFCARRYGPEDIDYWGQGTMVTVSS

SEQ ID NO: 1987 - protein, 118 aa, Artificial Sequence
  VH Domain (HC-345b)
QIQLVQSGAEVKKPGATVKISCKVSGYTFTDYGVIWMQQAPGKGLEWIGWINTYTGEPTYADDLKGRFTFTADTSTDTAYMELSSLRSEDTAVYFCARRYGPEDIDYWGQGTMVTVSS

SEQ ID NO: 1988 - protein, 118 aa, Artificial Sequence
  VH Domain (HC-345c)
QIQLVQSGAEVKKPGATVKISCKVSGYTFTDYGVIWMQQAPGKGLEWIGWINTYTGEPTYADDLKGRFTFTADTSTDTAYLELSSLRSEDTAVYFCARRYGPEDIDYWGQGTMVTVSS

SEQ ID NO: 1989 - protein, 111 aa, Artificial Sequence; identical to SEQ ID NO: 4
  VL Domain (3P10)

SEQ ID NO: 1990 - protein, 111 aa, Artificial Sequence
  VL Domain (LC-344a)
DVVMTQSPLSLPVTLGQPASISCRASESVDNYGISFMSWFQQRPGQSPRRLIYAASHQGSGVPDRFSGSGSGTDFTLKISRVEAEDVGVYYCLQSKEVPWTFGGGTKVEIK

SEQ ID NO: 1991 - protein, 111 aa, Artificial Sequence
  VL Domain (LC-344b)
DIVLTQSPLSLPVTLGQPASISCRASESVDNYGISFMSWFQQRPGQSPRLLIYAASHQGSGVPDRFSGSGSGTDFTLKISRVEAEDVGVYYCLQSKEVPWTFGGGTKVEIK

SEQ ID NO: 1992 - protein, 111 aa, Artificial Sequence
  VL Domain (LC-344c)
DIVLTQSPLSLPVTLGQPASISCRASESVDNYGISFMSWFQQRPGQSPRLLIYAASHQGSGVPDRFSGSGSGTDFTLKISRVEAEDVGVYFCLQSKEVPWTFGGGTKVEIK

SEQ ID NO: 1993 - protein, 111 aa, Artificial Sequence
  VL Domain (LC-344d)
DIVMTQSPLSLPVTLGQPASISCRASESVDNYGISFMSWFQQRPGQSPRLLIYAASHQGSGVPDRFSGSGSGTDFTLKISRVEAEDVGVYYCLQSKEVPWTFGGGTKVEIK

SEQ ID NO: 1994 - protein, 111 aa, Artificial Sequence
  VL Domain (LC-344e)
DVVLTQSPLSLPVTLGQPASISCRASESVDNYGISFMSWFQQRPGQSPRLLIYAASHQGSGVPDRFSGSGSGTDFTLKISRVEAEDVGVYYCLQSKEVPWTFGGGTKVEIK

SEQ ID NO: 1995 - protein, 111 aa, Artificial Sequence
  VL Domain (LC-344f)
DVVLTQSPLSLPVTLGQPASISCRASESVDNYGISFMSWFQQRPGQSPRRLIYAASHQGSGVPDRFSGSGSGTDFTLKISRVEAEDVGVYYCLQSKEVPWTFGGGTKVEIK

SEQ ID NO: 1996 - protein, 111 aa, Artificial Sequence
  VL Domain (LC-344g)
DVVMTQSPLSLPVTLGQPASISCRASESVDNYGISFMSWFQQRPGQSPRLLIYAASHQGSGVPDRFSGSGSGTDFTLKISRVEAEDVGVYYCLQSKEVPWTFGGGTKVEIK

SEQ ID NO: 1997 - protein, 111 aa, Artificial Sequence
  VL Domain (LC-344h)
DVVLTQSPLSLPVTLGQPASISCRASESVDNYGISFMSWFQQRPGQSPRLLIYAASHQGSGVPDRFSGSGSGTDFTLKISRVEAEDVGVYFCLQSKEVPWTFGGGTKVEIK

SEQ ID NO: 1998 - protein, 111 aa, Artificial Sequence
  VL Domain (LC-344i)
DVVMTQSPLSLPVTLGQPASISCRASESVDNYGISFMSWFQQRPGQSPRLLIYAASHQGSGVPDRFSGSGSGTDFTLKISRVEAEDVGVYFCLQSKEVPWTFGGGTKVEIK

SEQ ID NO: 1999 - protein, 111 aa, Artificial Sequence
  VL Domain (LC-345a)
DIELTQSPASLAVSLGQRATISCRASESVDNYGISFMSWYQQKPGQPPKLLIYAASHQGSGIPVRFSGSGSGTDFTLNIHPVEEEDAATYYCLQSKEVPWTFGSGTKLEIK

SEQ ID NO: 2000 - protein, 111 aa, Artificial Sequence
  VL Domain (LC-345b)
DIVLTQSPASLAVSLGQRATISCRASESVDNYGISFMSWYQQKPGQPPKLLIYAASHQGSGIPVRFSGSGSGTDFTLNIHPVEEEDAATYYCLQSKEVPWTFGSGTKLEIK

SEQ ID NO: 2001 - protein, 330 aa, Artificial Sequence
  variant Fc sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPALAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2002 - protein, 329 aa, Artificial Sequence
  variant Fc sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPALAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2003 - protein, 329 aa, Artificial Sequence
  variant Fc sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2004 - protein, 327 aa, Artificial Sequence
  variant Fc sequence
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2005 - protein, 326 aa, Artificial Sequence
  variant Fc sequence
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 2006 - protein, 330 aa, Artificial Sequence
  variant Fc sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2007 - protein, 107 aa, Artificial Sequence [sequence omitted]

SEQ ID NO: 2008 - protein, 106 aa, Artificial Sequence
  lambda constant region (exemplary)
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

What is claimed:

1. An antibody that binds GDNF Family Receptor Alpha-like protein (GFRAL), wherein the antibody comprises a heavy chain CDR1 comprising SEQ ID NO:46, a heavy chain CDR2 comprising SEQ ID NO:137, a heavy chain CDR3 comprising SEQ ID NO:225; a light chain CDR1 comprising SEQ ID NO:301, a light chain CDR2 comprising SEQ ID NO:376, and a light chain CDR3 comprising SEQ ID NO:426.

2. The antibody of claim 1, wherein the antibody binds within domain 3 of the extracellular domain of GFRAL.

3. The antibody of claim 1, wherein the antibody inhibits binding of RET to GFRAL.

4. The antibody of claim 1, wherein the antibody inhibits formation of a RET/GFRAL/GDF15 complex.

5. The antibody of claim 1, wherein the antibody does not inhibit binding of GDF15 to GFRAL.

6. The antibody of claim 1, wherein the antibody is a monoclonal antibody.

7. The antibody of claim 6, wherein the antibody is a humanized antibody.

8. The antibody of claim 6, wherein the antibody is an IgG1 antibody.

9. The antibody of claim 6, wherein the antibody is an IgG2 antibody.

10. The antibody of claim 6, wherein the antibody is an IgG4 antibody.

11. The antibody of claim 1, wherein the antibody is an single chain Fv (scFv) fragment, Fab fragment or F(ab')$_2$ fragment.

12. An antibody that binds GFRAL, wherein the antibody comprises a heavy chain variable region comprising SEQ ID NO:3, and a light chain variable region comprising SEQ ID NO:4.

13. The antibody of claim 12, wherein the antibody binds within domain 3 of the extracellular domain of GFRAL.

14. The antibody of claim 12, wherein the antibody inhibits binding of RET to GFRAL.

15. The antibody of claim 12, wherein the antibody inhibits formation of a RET/GFRAL/GDF15 complex.

16. The antibody of claim 12, wherein the antibody does not inhibit binding of GDF15 to GFRAL.

17. The antibody of claim 12, wherein the antibody is a monoclonal antibody.

18. The antibody of claim 17, wherein the antibody is an IgG1 antibody.

19. The antibody of claim 17, wherein the antibody is an IgG2 antibody.

20. The antibody of claim 17, wherein the antibody is an IgG4 antibody.

21. The antibody of claim 12, wherein the antibody is an scFv fragment, Fab fragment or F(ab')$_2$ fragment.

22. An antibody that binds GFRAL, wherein the antibody comprises a heavy chain variable region comprising SEQ ID NO:1982 and a light chain variable region comprising SEQ ID NO:1997.

23. The antibody of claim 22, wherein the antibody binds within domain 3 of the extracellular domain of GFRAL.

24. The antibody of claim 22, wherein the antibody inhibits binding of RET to GFRAL.

25. The antibody of claim 22, wherein the antibody inhibits formation of a RET/GFRAL/GDF15 complex.

26. The antibody of claim 22, wherein the antibody does not inhibit binding of GDF15 to GFRAL.

27. The antibody of claim 22, wherein the antibody is a monoclonal antibody.

28. The antibody of claim 27, wherein the antibody is an IgG1 antibody.

29. The antibody of claim 27, wherein the antibody is an IgG2 antibody.

30. The antibody of claim 27, wherein the antibody is an IgG4 antibody.

31. The antibody of claim 22, wherein the antibody is an scFv fragment, Fab fragment or F(ab')$_2$ fragment.

32. An antibody that binds GFRAL, wherein the antibody comprises a heavy chain CDR1 comprising SEQ ID NO:46, a heavy chain CDR2 comprising SEQ ID NO:137, a heavy chain CDR3 comprising SEQ ID NO:225; a light chain CDR1 comprising SEQ ID NO:301, a light chain CDR2 comprising SEQ ID NO:376, and a light chain CDR3 comprising SEQ ID NO:426.

33. An antibody that binds GFRAL, wherein the antibody comprises a heavy chain CDR1 comprising SEQ ID NO:48, a heavy chain CDR2 comprising SEQ ID NO:137, a heavy chain CDR3 comprising SEQ ID NO:225; a light chain CDR1 comprising SEQ ID NO:301, a light chain CDR2 comprising SEQ ID NO:376, and a light chain CDR3 comprising SEQ ID NO:426.

34. An antibody that binds GFRAL, wherein the antibody comprises a heavy chain CDR1 comprising SEQ ID NO:49, a heavy chain CDR2 comprising SEQ ID NO:139, a heavy chain CDR3 comprising SEQ ID NO:227; a light chain CDR1 comprising SEQ ID NO:303, a light chain CDR2 comprising SEQ ID NO:377, and a light chain CDR3 comprising SEQ ID NO:427.

35. An antibody that binds GFRAL, wherein the antibody comprises a heavy chain CDR1 comprising SEQ ID NO:47, a heavy chain CDR2 comprising SEQ ID NO:138, a heavy chain CDR3 comprising SEQ ID NO:226; a light chain CDR1 comprising SEQ ID NO:302, a light chain CDR2 comprising SEQ ID NO:377, and a light chain CDR3 comprising SEQ ID NO:426.

36. An antibody that binds GFRAL, wherein the antibody comprises a heavy chain CDR1 comprising SEQ ID NO:50, a heavy chain CDR2 comprising SEQ ID NO:140, a heavy chain CDR3 comprising SEQ ID NO:228; a light chain CDR1 comprising SEQ ID NO:304, a light chain CDR2 comprising SEQ ID NO:378, and a light chain CDR3 comprising SEQ ID NO:428.

37. An antibody that binds GFRAL, wherein the antibody comprises a heavy chain CDR1 comprising SEQ ID NO:46, a heavy chain CDR2 comprising SEQ ID NO:141, a heavy chain CDR3 comprising SEQ ID NO:225; a light chain CDR1 comprising SEQ ID NO:301, a light chain CDR2 comprising SEQ ID NO:376, and a light chain CDR3 comprising SEQ ID NO:426.

38. A pharmaceutical composition, comprising the antibody of claim 1 and a pharmaceutically acceptable carrier.

39. A pharmaceutical composition, comprising the antibody of claim 6 and a pharmaceutically acceptable carrier.

40. A pharmaceutical composition, comprising the antibody of claim 12 and a pharmaceutically acceptable carrier.

41. A pharmaceutical composition, comprising the antibody of claim 17 and a pharmaceutically acceptable carrier.

42. A pharmaceutical composition, comprising the antibody of claim 22 and a pharmaceutically acceptable carrier.

43. A pharmaceutical composition, comprising the antibody of claim 27 and a pharmaceutically acceptable carrier.

\* \* \* \* \*

UNITED STATES PATENT AND TRADEMARK OFFICE
CERTIFICATE OF CORRECTION

Page 1 of 9

PATENT NO. : 10,174,119 B2
APPLICATION NO. : 15/449839
DATED : January 8, 2019
INVENTOR(S) : Wenyan Shen et al.

It is certified that error appears in the above-identified patent and that said Letters Patent is hereby corrected as shown below:

In the Drawings

The replacement drawings embedded on pages 2-9 hereof, include changes to Fig. 4A, Fig. 4B, Fig. 5C, and Fig 5D indicated below and replace the original Fig. 4A, Fig. 4B, Fig. 5C, and Fig 5D.

Sheet 9, FIG. 4A, the reference "2J23" should instead recite "2I23".

Sheet 10, FIG. 4A (continued), the reference "2J23" should instead recite "2I23".

Sheet 11, FIG. 4B, the reference "2J23" should instead recite "2I23".

Sheet 12, FIG. 4B (continued), the reference "2J23" should instead recite "2I23".

Sheet 15, FIG. 5C, the line of text starting with "2J23" should be deleted.

Sheet 16, FIG. 5C (continued), the line of text starting with "2J23" should be deleted.

Sheet 17, FIG. 5D, the line of text starting with "2J23" should be deleted.

Sheet 18, FIG. 5D (continued), the line of text starting with "2J23" should be deleted.

Signed and Sealed this
Twenty-first Day of December, 2021

Drew Hirshfeld
*Performing the Functions and Duties of the*
*Under Secretary of Commerce for Intellectual Property and*
*Director of the United States Patent and Trademark Office*

FIG. 4A

```
VH Domains
Kabat     1          10          22           31---35       40             50--a------60---65
AbM       1          10          22       26--------35      40             50--a----58       65
Chothia   1          10          22       26-----32         40                    a-55       65
Contact   1          10          22           30----35      40         47------a----58       65
IMGT      1                      23       27------38  41                   56-----65         74
AHon      1                      23       27          42                   57                76
1C1       QMQLKQSGPGLVQPSQSLSITCTVS  GFSLND-YGVH  WIRQSPGKGLEWLG  VIW-SGGRTDYNAAFIS
P8G4      QVQLKQSGPGLVQPSQSLSITCTVS  GFSLTS-YGVH  WVRQSPGKGLDWLG  VLW-SGGSTDYNAAFIS 3P10      QIQLVQSGPELKKPGETVKISCKAS  GYTFTD-YGVI  WVKQAPGKALKWMG  WINTYTGEPTYADDLKG
12A3      QIQLVQSGPELKKPGETVKISCKAS  GYPFTI-YGMN  WVEQAPGKGLKWMG  WINTYSGVPTYADDFKG
2B8       QIQLVQSGPELKKPGETVKISCKAS  GYTFTT-YGMS  WVKQAPGKIFKWMG  WINTYSGVPTFVDDFRG
22N5      QNQLVQSGPELKKPGEIVKISCKTS  GYTFTD-YSMH  WVKKTPGKGFKWMG  WINTETGEPTYADDFKG 2I23      QAQLQQSGAELVKPGASVKLSCKAS  GYSFTS-YNID  WVRQRPEQGLEWIG  WIFPGDGSTKYNEKFKG
6N16      QVQLQQSGSELVKPGTSMKLSCKAS  GYTFTS-YNIN  WVRLRPEQGLEWIG  WIFPGDDSIKYNENFRG
1B3       QVHLQQPGAELVKPGASVKLSCKAS  GFTFTG-YNIN  WVRLRPEQGLEWIG  WIFPGDDNAKYNEKFKG 25M22     QVQLQQSGPDLVKPGASVKISCKAS  GYTFTS-YWVN  WMKQRPGKGLEWIG  RIYPGDGDTNYNGKFKG
19K19     QVQLQQSGPDLVKPGASVKISCKAS  GYAFTS-YWMN  WVKQRPGKGLEWIG  RIYPGDGDTNYNGKFKG
5F12      QVQLKQSGTELVRPGASVKLSCKAS  GYTFTD-YYIN  WVKQRPGQGLEWIA  RIYPGNGNTYHNEKFKG 5A20      QVQLQQSGPELMKPGASVILSCKAI  GYTFTD-YWIE  WVKERPGHGLEWIG  EILLGSDSIHFNEKFKG
8D8       QVQLKESGPGLVAPSQSLSITCTVS  GFSLSR-YSVH  WVRQPPGKGLEWLG  MIW-GFGSTDYNSALKS
17J16     QVQLQQSGAELAKPGASVKMSCKTS  GYTFTD-YWIH  WVKQRPGQGLEWIG  YINPNSNYAEYNQKFKV
2B3       EVKLVESGGGLVQPGGSLKLSCAAS  GFTFSD-YFMF  WVRQTPEKRLEWVA  YISNDGDSTYYPDTVQG
8C10      QVQLQQSGVELARPGAAVKLSCKAS  GYTFAN-YGLT  WVKQRTGQGLEWIG  EIYPGSGHTHYNEDFKG
2A9       EVKLVESGGGLVKPGGSLKLSCAAS  GFTFST-YAMS  WVRQTPEKRLEWVA  SIT-SGGTTYYTDSVKG
24G2      QVQLQQSGAELLKPGASVKLSCKAS  GYTFTT-YWMH  WVKQRPGQGLEWIG  MIHPNSGSSNYNEKFKN
6G9       QVQLHQPGAELVKPGASVKLSCKTS  GYTFTS-YWMQ  WVKQRPGQGLEWIG  EIDPSDSYTNYNQKFKG
2B11      DVQLQESGPGLVKPSQSLSLTCSVT  GYSITSGYYWN  WIRQFPGNKLEWMG  HIA-NDGSNYYNPFLKH P1B6      EVQLQQSGPELVKPGASVKMSCKAS  GYTFTD-YMN   WVKQTHGKSLEWIG  DINPNNGGPIYNQKFKG
1A3       EVQLQQSGPELVKPGASVKISCKAS  GFTFTD-YYMN  WVKQSHGKSLEWIG  DIIPNNGVTSYNQKFKG
P1H8      EVQLQQSGPELVKPGASVKISCKAS  GYTFTD-YYMN  WVKQSHGKSLEWIG  DINPNNGGTTYNQKFKG
```

FIG. 4A (continued)

```
Kabat         70        80    abc    90      95--100--------102          110
AbM           70        80    abc    90      95--100--------102          110
Chothia       70        80    abc    90      96-100------101             110
Contact       70        80    abc    90 93-----100------101              110
IMGT     75              89                105---------------117
AHon                                       106 109            138
1C1          RLSISKDNSKSQVFFKMSSLQPNDTAIYYCAR  WALYFLYGG---SMDY    WGQGTSVTVSS
P8G4         RLSISKDNSKSQVFFKMNSLQADDTAIYYCAR  N----------FGDY     WGQGTSVTVSS 3P10         RFAFSLETSASSASLQINNLKNEDTATYFCAR  RYGPE-------DIDY    WGQGTTLTVSS
12A3         RFAFSLETSASTAYLQINNLKDEDTATYFCAS  ATG----------NY     WGQGTTLTVSS
2B8          RFAFSLETSASTAYLQIGNLKNEDTATYFCAR  RSSYYPYW----YFDV    WGTGTTVTVSS
22N5         RFAFSLETSANTAHLQITNLKNEDTATYFCVK  GTL----------NY     WGQGTTLTVSS 2I23         QATLTTDKSSSTTYIHLSRLTSEDSAVYFCAR  SGIYYGS-----HFVY    WGQGTLVTVSA
6N16         KATLTTDKSSSTAYMHLSRLTSDDSAVYFCAR  SGIFYGN-----NFAY    WGQGTLVTVSA
1B3          KATLTTDKSSNTAYMQLSRLTSEDSAVYFCAR  TPVLSN------YFDY    WGQGTTLTVSS 25M22        KATLTADKSSSTAYMQLSSLTSEDSAVYFCAR  AYLLRLRRTGYYAMDY    WGQGTSVTVSS
19K19        KATLTADKSSSTAYMQLSSLTSEDSAVYFCAR  AYLLRLRRTGYYAMDY    WGQGTSVTVSS
5F12         KATLTAEKSSSTAYMQLSSLTSEDSAVYFCAR  EGLYYDYR---YFDY     WGQGTALTVSS 5A20         KATISADTSSNTAYMQLSSLTTEDSAIYYCVR  QDWNW-------YFDV    WGTGTTVTVSS
8D8          RLSITKDNSKSQFFLKMNSLQTDDTAMYYCAR  IHTT--------AGSY    WGQGTLVTVSA
17J16        KATLTADKSSTAYLQLSRLTSEDSAVYCAR    FDWNW-------YFHV    WGAGSTVTVSS
2B3          RFTISRDNAKNTLYLQMSRLRSEDTAMYYCTR  QGAQA-------TLDY    WGQGTTLTVSS
8C10         KATLTADRSSSTAYMELRSLTSEDSAVYFCAR  RIQLLLPVG---GFVY    WGQGTLVTVSA
2A9          RFTISRDNARNILYLQMSSLRSEDTAMYYCAR  DGNFYYY-----GMDY    WGQGTSVTVSS
24G2         KATLTVDKSSSTAYMQLSSLTSEDSAVYFCAR  SDYGFIP-----YFDY    WGQGTTLTVSS
6G9          KATLTVDTSSTAYMQLSSLTSEDSAVYYCAR   PLDRSAY-----YFDY    WGQGTTLTVSS
2B11         RVSITRDTSKNQFFLKLNSVTIQDTATYYCAR  GGSYFD------YVDY    WGQGTTLTVSS P1B6         KATLTVDKSSSTAYMELRSLTSEDSAVYYCAR  SDSA--------WFTY    WGQGTLVTVSA
1A3          KATLTVDKSSSTAYMELRSLTSEDSAVYYCAR  EWLLR-------GMDY    WGQGTSVTVSS
P1H8         KATLTVDKSSSTAYMELRSLTSEDSAVYYCAR  QGPW--------YFDV    WGTGTTVTVSS
```

FIG. 4B
```
VL Domains
Kabat      1             10          20      24-27abcde-----34       40              50----56
AbM        1             10          20      24----30abcde--34       40              50----56
Chothia    1             10          20         26--30abcd-32        40           50--
Contact    1             10          20              30abcde-----36  40      46--------55
IMGT       1                         23        27--------38   41                  56-65 69
                                                                                     | |
AHon       1                         23                 42                        58    72
1C1        DVVLTQTPLSLPVSPGDQASISC   RSSQSLVHSSGITYLH    WYLQKPGQSPKLLIY          KLSNRFS
3P10       DIVLTQSPVSLAVSLGQRATISC   RASESVDNYGI-SFMS    WFQQKPGQPPKLLIY          AASHQGS
12A3       DIQMTQSPSSLSASLGERVSLTC   RASQDIG-----SSLN    WLQQEPDGTIKRLIY          ATSSLDS
1B3        DIQMTQSPSSLSASLGGKVTITC   KASQDIS-----KYIS    WYQHKPGKSPRLLIH          YTSTLQP
2B3        QIVLTQSPAIMSASLGEEITLTC   SASSSV------FYMH    WYQQKSGTSPKLLIY          STSNLAS
2B11       DIQMTQTTSSLSASLGDRVTINC   RASQDIS-----NYLN    WYQQKPDGTVKLLIY          YTSRLHS
2B8        DIQMTQSPASLSASVGETVTITC   RPSENIY-----SYLT    WFQQEQGKSPQLLVY          NAQTLAE
22N5       DIKMTQSPSSMYASLGERVTITC   KASQDIK-----SYLN    WFQQKPGKSPKTLIY          RTKRLVD
P1B6       QIVLTQSPAIMSASPGEKVTMTC   SASSSV------SYMY    WYQQKPGSSPRLLIY          DTSNLAS
P8G4       QIVLTQSPAIMSASPGEKVTMTC   SASSRV------SYMH    WYQQKSGTSPKRWIY          DTSKLAS 8D8        DIVMTQSQKFMSTSIGDRVSVTC   KASQNVG-----TNVA    WYQQKPGQSPKALVY          STSYRYS
2A9        DIVMTQSQKFMSTSVGDRVSITC   KASQNVG-----TAVA    WYQQKPGQSPKILIY          SASNRFT 8C10       DFVLTQSPATLSVTPGDSVSLSC   RASQSIS-----NNLH    WYQQKSHESPRLLIK          YASQSIS
24G2       DILLTQSPAILSVSPGERVSFSC   RASQSIG-----TSIH    WYQQRTNGSPRLLIK          YASESIS 2I23       DVVMTQTPLTLSVTIGQSASISC   RSSQSLLDSDGKTYLN    WLLQRPGQSPKRLIY          LVSKVDS
6N16       DVVMTQAPLILSVTIGQPASISC   KSSQSLLDGDGETYLS    WLLQRPGQSPKRLIY          LVSKLDS
5A20       DVVMTQTPLTLSVTIGHPASISC   KSSQSLLDFDGKTYLN    WLFQRPGQSPKRLFY          LVSKLDS
17J16      DVALTQIPLTLSVTVGQPASISC   KSSQSLSDSDGKTYLN    WLLQKPGQSPKRLIY          LVSRLGS
1A3        DIVMTQAAFSNPVTLGTSASISC   RSSKSLLHSNGITYLY    WYLQKPGQSPQLLIY          QMSNLAS
P1H8       DVLMTQTPLSLPVSLGDQASISC   RSSQTIVHSNGYTYLE    WYLQKPGQSPKLLIY          KVSNRFS 25M22      DVVLTQTPLSLPVNIGDQASISC   KSTKSLLNSDEFTYLD    WYLQKPGQSPQLLIF          LVSNRFS
19K19      DVVLTQTPLSLPVNIGDQASISC   KSTKSLLNSDEFTYLD    WYLQKPGQSPQLLIY          LVSNRFS 5F12       NIVLTQSPASLAVSLGQRATISC   RASESVDTYGN-SFMH    WYQQKPGQPPKLLIY          LASNLES
6G9        DIVLTQSPASLAVSLGQRATISC   RASESVDFSGN-SFMH    WYQQKPGQPPKLLIY          RASNLDS
```

FIG. 4B (continued)

```
Kabat         60           70           80           89-------97
AbM           60           70           80           89-------97
Chothia       60           70           80            91----96
Contact       60           70           80           89------96
IMGT      70           89                       105------117
AHon      73           91                       107      138
1C1           GVPDRFSGSGSGTDFTLKISRVEAEDLGVYFC  SQSTHVPPWT  FGGGTKLEIK  (1852)
3P10          GVPARFSGSGSGTDFSLNIHPMEEDDSAMYFC  LQSKEVP-WT  FGGGTKLEIK  (1853)
12A3          GVPKRFSGSRSGSDYSLTISSLESEDFVDYYC  LQYASSP-YT  FGGGTKVEIK  (1854)
1B3           GIPSRFSGSGSGRDYSFSISNLEPEDIATYYC  LQYDNL--YT  FGGGTKLEIK  (1855)
2B3           GIPSRFSGSGSGTFYSLTISSVEAEDAADYYC  HQWS----ST  FGGGTKLEIK  (1856)
2B11          GVPSRFSGSGSGTDYSLTITNLEQEDIATYFC  QQGNTLP-FT  FGSGTKLEIK  (1857)
2B8           GVPSRFSGSGSGTHFSLKINSLQPEDFGTYYC  QHYYGYP-FT  FGSGTKLEIK  (1858)
22N5          GVPSRFSGSGSGQDYSLTVSSLEYDDVGIYYC  LQYVEFP-LT  FGDGTKLELK  (1859)
P1B6          GVPVRFSGSGSGTFYSITISRMEAEDAATYYC  QQWNSYP-PT  FGGGTKLEIK  (1860)
P8G4          GVPARFSGSGSGTSYSLTISSMEAEDAATYYC  QQWNNNP-PT  FGAGTTLELK  (1861)

8D8           GVPDRFTGSGSGTDFTLTISNVQSEDLAEYFC  HQYNSYP-LT  FGAGTKLELK  (1862)
2A9           GVPDRFTGSGSGTDFTLTISNMQSEDLADYFC  QQYSSY--FT  FGGGTKLELK  (1863)

8C10          GIPSRFSGSGSGTDFTLSINSVETEDFGVYFC  QQSNSWP-HT  FGGGTKLEIK  (1864)
24G2          GIPSRFSGSGSGTDFTLIINSVESEDIADYYC  QQSNSWPTFT  FGAGTKLELK  (1865)

2I23          GVPDRFTGSGSGTDFTLKISRVEAEDLGVYFC  WQGTHFP-LT  FGAGTKLELK  (1866)
6N16          GVPDRFTGSGSGTDFTLKISRVEAEDLGVYYC  CQSTHFP-LT  FGAGTKLELK  (1867)
5A20          GVPDRFTGSGSGTDFTLKISRVEAEDLGVYYC  WQGTHFP-RT  FGGGTKLEIK  (1868)
17J16         GVPDRFTGSGSGADFTLKISRVEAEDLGVYYC  WQGTHFP-QT  FGGGTKLEIK  (1869)
1A3           GVPDRFSSSGSGTDFTLRISRVEAEDVGVYYC  AQHLELT-WT  FGGGTKLEIK  (1870)
P1H8          GVPDRFSGSGSGTDFTLKISRVEAEDLGVYYC  FQGSHVP-WT  FGGGTKLEIK  (1871)

25M22         GVPDRFSGSGSGTDFTLKISRVEAEDLGVYYC  FQSNYLP-YT  FGGGTKLEIK  (1872)
19K19         GVPDRFSGSGSGTDFTLKISRVEAEDLGVYYC  FQSNYLP-YT  FGGGTKLEIK  (1873)

5F12          GVPARFSGSGSRTDFTLTIDPVEADDAATYYC  HQNNEDP-PA  FGGGTKLEIK  (1874)
6G9           GIPARFSGVGSRTDFTLTINPVEADDVATYYC  QQSNEDP-YT  FGGGTKLEIE  (1875)
```

FIG. 5C

```
Domain 2 Binders
Antibody VH Domain
Kabat    1          10         22      31---35          40          50--a------60---65
AbM      1          10         22    26-------35        40          50--a----58      65
Chothia  1          10         22    26----32           40              a-55         65
Contact  1          10         22      30---35          40          47------a----58  65
IMGT     1                     23    27-----38   41                     56-----65    74
AHon     1                     23    27          42                     57           76
1C1      QMQLKQSGPGLVQPSQSLSITCTVS  GFSLNDYGVH  WIRQSPGKGLEWLG  VIW-SGGRTDYNAAFIS
2A9      EVKLVESGGGLVKPGGSLKLSCAAS  GFTFSTYAMS  WVRQTPEKRLEWVA  SIT-SGGTTYYTDSVKG
5A20     QVQLQQSGPELMKPGASVILSCKAI  GYTFTDYWIE  WVKERPGHGLEWIG  EILLGSDSIHFNEKFKG
8C10     QVQLQQSGVELARPGAAVKLSCKAS  GYTFANYGLT  WVKQRTGQGLEWIG  EIYPGSGHTHYNEDFKG
8D8      QVQLKESGPGLVAPSQSLSITCTVS  GFSLSRYSVH  WVRQPPGKGLEWLG  MIW-GFGSTDYNSALKS
12A3     QIQLVQSGPELKKPGETVKISCKAS  GYPFTIYGMN  WVEQAPGKGLKWMG  WINTYSGVPTYADDFKG
17J16    QVQLQQSGAELAKPGASVKMSCKTS  GYTFTDYWIH  WVKQRPGQGLEWIG  YINPNSNYAEYNQKFKV
25M22    QVQLQQSGPDLVKPGASVKISCKAS  GYTFTSYWVN  WMKQRPGKGLEWIG  RIYPGDGDTNYNGKFKG
19K19    QVQLQQSGPDLVKPGASVKISCKAS  GYAFTSYWMN  WVKQRPGKGLEWIG  RIYPGDGDTNYNGKFKG
22N5     QNQLVQSGPELKKPGEIVKISCKTS  GYTFTDYSMH  WVKKTPGKGFKWMG  WINTETGEPTYADDFKG
```

FIG. 5C (continued)

```
Kabat         70           80    abc         90      95--100-------102         110
AbM           70           80    abc         90      95--100-------102         110
Chothia       70           80    abc         90      96-100------101           110
Contact       70           80    abc         90 93-----100------101            110
IMGT     75                      89                  105--------------117
AHon                                            106 109            138
1C1      RLSISKDNSKSQVFFKMSSLQPNDTAIYYCAR   WALYFLYGG---SMDY     WGQGTSVTVSS  (1884)
2A9      RFTISRDNARNILYLQMSSLRSEDTAMYYCAR   DGNFYYY-----GMDY     WGQGTSVTVSS  (1885)
5A20     KATISADTSSNTAYMQLSSLTTEDSAIYYCVR   QDWNW-------YFDV     WGTGTTVTVSS  (1887)
8C10     KATLTADRSSSTAYMELRSLTSEDSAVYFCAR   RIQLLLPVG---GFVY     WGQGTLVTVSA  (1888)
8D8      RLSITKDNSKSQFFLKMNSLQTDDTAMYYCAR   IHTT--------AGSY     WGQGTLVTVSA  (1889)
12A3     RFAFSLETSASTAYLQINNLKDEDTATYFCAS   ATG---------NY       WGQGTTLTVSS  (1890)
17J16    KATLTADKSSSTAYLQLSRLTSEDSAVYYCAR   FDWNW-------YFHV     WGAGSTVTVSS  (1891)
25M22    KATLTADKSSSTAYMQLSSLTSEDSAVYFCAR   AYLLRLRRTGYYAMDY     WGQGTSVTVSS  (1892)
19K19    KATLTADKSSSTAYMQLSSLTSEDSAVYFCAR   AYLLRLRRTGYYAMDY     WGQGTSVTVSS  (1893)
22N5     RFAFSLETSANTAHLQITNLKNEDTATYFCVK   GTL---------NY       WGQGTTLTVSS  (1894)
```

FIG. 5D

```
Domain 2 Binders
Antibody VL Domain
Kabat     1              10         20       24-27abcde-----34      40            50----56
AbM       1              10         20       24----30abcde--34      40            50----56
Chothia   1              10         20       26--30abcd-32          40            50--
Contact   1              10         20           30abcde-----36     40        46--------55
IMGT      1                         23       27--------38    41                  56-65 69
                                                                                   | |
AHon      1                         23                  42                       58    72
1C1       DVVLTQTPLSLPVSPGDQASISC   RSSQSLVHSSGITYLH     WYLQKPGQSPKLLIY          KLSNRFS
2A9       DIVMTQSQKFMSTSVGDRVSITC   KASQNVG-----TAVA     WYQQKPGQSPKILIY          SASNRFT
5A20      DVVMTQTPLTLSVTIGHPASISC   KSSQSLLDFDGKTYLN     WLFQRPGQSPKRLFY          LVSKLDS
8C10      DFVLTQSPATLSVTPGDSVSLSC   RASQSIS-----NNLH     WYQQKSHESPRLLIK          YASQSIS
8D8       DIVMTQSQKFMSTSIGDRVSVTC   KASQNVG-----TNVA     WYQQKPGQSPKALVY          STSYRYS
12A3      DIQMTQSPSSLSASLGERVSLTC   RASQDIG-----SSLN     WLQQEPDGTIKRLIY          ATSSLDS
17J16     DVALTQIPLTLSVTVGQPASISC   KSSQSLSDSDGKTYLN     WLLQKPGQSPKRLIY          LVSRLGS
25M22     DVVLTQTPLSLPVNIGDQASISC   KSTKSLLNSDEFTYLD     WYLQKPGQSPQLLIF          LVSNRFS
19K19     DVVLTQTPLSLPVNIGDQASISC   KSTKSLLNSDEFTYLD     WYLQKPGQSPQLLIY          LVSNRFS
22N5      DIKMTQSPSSMYASLGERVTITC   KASQDIK-----SYLN     WFQQKPGKSPKTLIY          RTKRLVD
```

FIG. 5D (continued)

```
Kabat        60           70           80           89-------97
AbM          60           70           80           89-------97
Chothia      60           70           80            91----96
Contact      60           70           80           89------96
IMGT         70              89                     105------117
AHon         73              91                     107      138
1C1       GVPDRFSGSGSGTDFTLKISRVEAEDLGVYFC  SQSTHVPPWT  FGGGTKLEIK  (1895)
2A9       GVPDRFTGSGSGTDFTLTISNMQSEDLADYFC  QQYSSY--FT  FGGGTKLELK  (1896)
5A20      GVPDRFTGSGSGTDFTLKISRVEAEDLGVYYC  WQGTHFP-RT  FGGGTKLEIK  (1898)
8C10      GIPSRFSGSGSGTDFTLSINSVETEDFGVYFC  QQSNSWP-HT  FGGGTKLEIK  (1899)
8D8       GVPDRFTGSGSGTDFTLTISNVQSEDLAEYFC  HQYNSYP-LT  FGAGTKLELK  (1900)
12A3      GVPKRFSGSRSGSDYSLTISSLESEDFVDYYC  LQYASSP-YT  FGGGTKVEIK  (1901)
17J16     GVPDRFTGSGSGADFTLKISRVEAEDLGVYYC  WQGTHFP-QT  FGGGTKLEIK  (1902)
25M22     GVPDRFSGSGSGTDFTLKISRVEAEDLGVYYC  FQSNYLP-YT  FGGGTKLEIK  (1903)
19K19     GVPDRFSGSGSGTDFTLKISRVEAEDLGVYYC  FQSNYLP-YT  FGGGTKLEIK  (1904)
22N5      GVPSRFSGSGSGQDYSLTVSSLEYDDVGIYYC  LQYVEFP-LT  FGDGTKLELK  (1905)
```